United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 54

SEQ ID NO: 814 - DNA, 493615 bp, Homo sapiens
caccaacaatgcaacaacaaactcccaaattttccaatagaggacacgtataggattttgctttgatgttacacatagatgatgcagcattcacacacgtttaaggatctgacaccctgacatgcagccagtgggtgccttaggagtctgcgccttagtgttatgccatggaacaggcccagctaatgtttgtctgattttatagctgaccctacgttactgtaattgagggcagggctcatgttttggcagggtctggagtttaactatgcagatttggtttttagaaggtcataacaggcggtgtgtgctgccagataccagccaaagtagtagaaactggattccaatgatataccacagggagggatttaatccagaaacaccaccacagtcagtataatcctcctgttgttaaaaaaaaaagaaaagaacagaaaaagaaaaatctaaaaatcttgaaaaatatttagtaacacatctttcagagtaatccatatttagttcactttctgaacttaccttataaaactgctgtaattgaaatccaaagaaattactttctcctagattttatcattgaggaatttccctagcatcatttgacaaatgctttaaatttttagttgtagcttttgatgattatgaaagaaaataataaatgctgtttgaataatatactaattttaaagaaaaaactttcacagtatcaaaaatcctatatatttataaatgcaagaaataaatgtaaaatttaatagtaggttttataattcccaagaattatgattttagcaactatgctccatatggtaaagttggggactggtaaaataaatacatttccatttcccatatttcttatacaatttataaggctcaacatagagtgcaatcatagcatctggaccttcatcaagaattaaagtaaaatgggaataatgtatttgaaccattgtttatgttggttcaaatacattatttggacacatataggattttgctttgcaaatatatatccaaaatagagagctaagctaggaagagatttgtcttgagacaaccaagaaatattagaatgaatatactcccattaactccccacagtctagtggtagctcatttagttccctcttaatgcaaaagtattattcatcttttattcctaggttctatatttgataacattgtccacatcctttaattccttttaacatagtgaatttcatttttaaaaacctccttattatttttaaattttatttcaatagattttggggaacaggtggttttggttacatggataattctttagtggtgatttctgagattttggtgcacctgtcacccaagcaatgtacaatgcaccgaatgtatgtagtactttatcccttactcccattcctcccaagtccccaaagtccattatatcattcttatgcctctgcatccttatagcttagctcccacttagaagttagaacatacaatatttggttttccattcatgagttacttcccttagaaaaatggtctccaactccatctaggttgctgcaaatgccattatttcattcctttttatggctgaggtgtattccatgttgtatatataccacattttctttaatcattggttgatggacatttaggttggttccacatttttgcaattttgaattgtgctgctataaacatgcatgcgcaagtgtctttttcataaaatgacttcttttcctcagggtagatacacagcagtgggactactggatcaaatggtagttctacttttcattctttaaggaatcaccatactgttttccatagtggttgtattagcttacattcccaccagcagtgtacaaagtgttttttttttttttttttttttaaccacatccattatttttttattatggccattagtgcaggagtaaggtggtatcacattgtggttttaacatgcatttccctgataattagtgatgttgagcaatttttcatatgttttggccatttgtatatcattttttgagaactgtctattcatgttttttgcccactttctgatgggattatttgaaagaccatatatttaaacatctttaaagaatctgctaatccaaggtagatgttctaagaatcaaaataataggttgaacaattttctttcaggataattttacaaagattctaagctcccaaagaataagaactttggctctttttgttcaccaggatttaatacagtgctgccacacagtaaataaaattatttctttaattgtattttaaggcagcagaactattttgttaagaagaaagaaagctgggagaaaagaatctatgaaaaaattttagtttcaatcaatttacatcccaaatctaaatagaatcataaaataatcaattcttagtcttcatcctctttgacctttcagaagcatttgacaaatatatgacattgtctccttgaaatacgttctcatgtacctttggctaatgtactcttctggtttttcttgaaacttgtttgtgtctctctccttggcttgacctcctttctttcatgctctctaaaatgttagacttttccaggtgttacttctctctcctttcttcttcttcctttacactttgttcctagatgatctaatccccagtcctatggctttaatttcatccgtttcctaataactcactcttttgtatgttcaatcctgtattctcctctggtctgtgtattcattgatctctacctttctcctcttgtatgtctcatagggatttcaaacttgacttgccttgcccctaatataattcttctggtatcagtaaatatctggtaccagtaaatagcatggcatgatcttgacctccctgggctcaggtggtcctcccacctcagcctcccaagtagctgggactatagatgtgcaccaccacacctgtctaattttttatattttttgcagagtgggggtttcagctgggaatccatcctctaactctaccttcaaaatacatccccaaacttactgcttgtcactactgcaggtccaagtcaccattacttcttgcttccacttttgcaaaagctgtctcacttgtcccatggcttctactctgcccttttataaacgcttctccaaaaagcagtcttcttaacaccacacattctttcactccctgcttgacatttctcatcattctcagagcaaaatctacattctttattgaggtctacaaagccttatgaggtctggagcctggctgtctcatcttcccaccttctcctctcccgcctactcactctgcttcagtaacactggctttctctgcaacaggccaagctgtttactgcctttgcatttgttctttttgttcagatgcttttctctccaggtagggtaaacagataaaaaacagggtaccagtaacaattgaatatcagattaaaaaaaaaacaaatactttatataaatgtatttcatacacagaagagtggctagatacatagcaacgatttgataaatgaagagtaggtactcaataaagcagcacacatggactggttagaaacactatgaggtattaacttaaagaagtcattgtcacttaaacaggagtactccccagttatgattaagtgttaatttgaataaaaattaccacacaagacccatttgtgtattaataacatattttgtcatctttatactctacaaatgtgttatggaaagaaaaatattctctttggcccttatttcactgtttttatttttatatataatttttgtttaatttcctctgtgtgatgatgagatatgtctgtttctatttgggaggtggtagtttagataagttatttgggctccctgtggtgtgcatgtcagttcacactgaaaaatgtgtcttttaagtttcctgatcatgtcttcccaagcattttgcatggtgcaagtccatgtaatgtatttcatagaatcatttcaagtcttattatggcatacattctacacaaatgcactgatgtgggaggaactcagcattatttctgtcctatagagactgaaatcccactgacaccatgaccagatataataaatcggtctgatttttaaatgattatttaagtagaaaataacagattggtactttcagtttagaacattaaaatggaaaaagaatgcagtgccaatattatatatatatttattttaaaatatgataaaactaattttattagacttccttataggggaacctcccttaaaagactgtgttattaaagatatcaactaagaattctttattcctttctcattactctttaaaaaatctaaaccatagtaaaattcatatggtttttgccccaaagttttcttcatacagcatgcgttaccagtggctaaaatcttttgaagttactgttgctaaactcttactctgcctttctttccccattcagaacctgggacaactaattgcatacagtacaagcttaataatttttaatttattaaatttagaagtacatgtttcaaaagaaaatgttctggtcatttggctaaaaggtttttgatctttttttctgaattatagccatcatttaatttccttcaaaatgcaaatcgctggtgaagacagccatcaaatcatggactaacttttgaattcaggtaagtctgtactaaagttaccaccagcaactttgaagacaatctatatttaaaaatttttaggcatgtagatactgcataataataggaataatgcccctagcaaataatttgttctccgacatgtcaccttaacactcttacacattaactcgtgagataggtaggtagtagtatatttattcaactctttaaatgtagacagattatgtacccaataatatgctttataaattgggtttgcataaaataataaatttctcaatggacagaattggcttgctttacttctttgattaataaatgttagctttttgagtcttcataaacttgttatcaaaaagtcttgtttgaacacttgagttctgatgaagtcctcatggtatggagcttcataactgtttttgtataatctatatccttccggactctaccgggtataagggccccttggtaggctttggagattatactaccattctaccttgcttgtgagcagaacctaatccaacagaaattgctagttttagccagactacattggagcatagaccataacctttatggtccttaatgtgggaaacaactgccaactaacatttcagtattttttgtaatgatttttttcaacttaattgtttcagagaaaataatacttcctttgatatcattatatcaacattcaaatagcactaagtggattcactgttctatacagataactgtgtttttaaatactgaaagcatattttgttaatgtaaaatatacatcatcgatattatgtattcctttgatacaataatataaaggaatctcaaatgttttctttttggagatcagaaggatatagattatacttctacaattatgaagctccataccatgaggacttcatcaaaactcaagcaaatgaaaaagctaacatttattaatcaaagaagtaaagcaagtcaataattgtccattgagaaatttattattttatgcaaacacaatttataaagcatattatctggtacataaatatcctagttgagtccatggtgatatataattattgccatgatagatttataattatagttcaaggaaagtaccataataggaaaatgttattttggtgggggggggggggggtggtggtcttaggttaaaaagattttaaagtcactgttgctatatatatatatatatatattttttttttttttttttttttttggaaatggagtctagctctgtgatctaggctggagtgcagtggcacaatctcagcttactgcaacttccacctcctaggctcaagcaattctcctgcctcagcctctggcgtagctgggaccaccatgcccagctaatttttgtattttagtagagatggggtttcaccaggttgcccaggctggtctcgaactcctgacctcaggtgatgcacccacctcggcctcccaaagtgctgggattataggcttgaaccactgcacccagccgttgctataagtttttaagagaaaggtaaaaagagagctggcctactcaagagcaatacttacatattttttagtgtaactgataacctataaatcttatctaaaaattctatgattgacagaagtaagcttttgaatcaaaagggaaaataaggacaattatagaaatataatttgattacacttttcttgtgtaatggttgactacctatgaacttctttcaggaattaataataattcaaataattgcctatatatcaatttttaaaatgtgtatatgaagatattaaagcaacgtttccttactttggcgtcttttgccatgaaaactattcttttattatgccagaagacttgtggttattttctgagactccctctgctattctactccccaccctctatcacccctgcctgtgaattcactccattcatagtaatggccacatctccatctagtggcttcctaatcaatgactacttggaaaccaatgacaaacacaacgaaagtgcgtgctctagtaatacatcatgatgattccagagcattagaaaagaaattgcaaaacagtaaatgaagaactaaatgcaaatccaagacccaaaacatctctttagtagtattgaatagagaactcagaaatttcttaaaaggttaattaataattttgggctagataatgtatattaaataaaatgaacttagaaactagaagcacttattctaaaatatttcaataagaatattttgagagtaaaaaatctaaaaagttatttaagtcagatttattttaaaaagtagaaaaatctgaaaggaattgaaagagtgcattaaatttgtgttagcatcttttgtaaataaattgagataaccacctctaaaaattgtcattaggtagttctcataaaataccatgaagcctgtatatctgtctctgtaatgacaatttttacacaaaaactttatgaaaaatgatttttacataaatattgaatatgtttcatttaggattagaaatgtacatgccatttgaaatcagctatttacaaaacaacaacattggtcctgagattttaataacctggtttcaggaacattaatatcgcagatttaggaatatgggtgattttctagaatttcaagccaaaaacaaaaactaagaaaaattagagaaagtgactgaccatccacaccacatgaaaacttgcagtaaaatgaagataggagctgacatcatggtacaggcacgactcgttgtgcacttaagttgatcctattaataacgggcaaagtagcaagtataggaaaaggaaagaaaacacagaagacatacaagatgagatttcatgcaatttgctggcagttaacgtgagtctccatccagagcagattcacagtgaccattgcaaataagcattaccaaaataactccactgctaaagaaacacaagatattattagcacaccaagctactgagcaacagttgtactttcacacacaacccatttataggagcttcaattgctgaacatttttgtcttggtcaaatccttttaatggcttgatcataagatatagcctcctagaataatattttgggcaataggcttttaagtcacttttcaagttcatctgaatttaatatttctagtgtcaaaaaactggtgacaaatagttgatgagcgaagtttctctaatgagtgacatgacccttggcccttcataaaacattctttgggggaataattttacatgggcaacgtgctgaagttgcagtagacagaataacaggagtccgcctatctggacttaatatatcttaaaaagaaaaaaaaaacgcttagttgcaatgttgaattactctccctagcaaggatcaataatccctcacagagataactgggattgactggctaatacatctttcatttttagtccccattactgattttattacttctttgtgctatttttaatttatattatctaattgcataatattatctgtgaaaatgttttgtcctttctgggacaaatgcagctatgtatttgagtaggtaaactaaataactcaaataatttatgagataatgctttacaagtttggatattcattggtgtgtgcacacactgaagaatcagaattaggaagtattgtatttaaaattagttaaaaagaggtagacagagatttttatgtagacttcatctttgagaatagattaatatttcttaagaattttaaaagcataaagctaatgtagtacatactgatgacatattacctaccttgtatataatcaatacacagtaaatcagaatagtatttattagagaaagatagctgaactataggaaaagtagtaagccatctttaagtgacatatattaaatatgatttgtaatattttatcaaaccctatgtaattgacctggtctagtttcaaacactagaaaaagaaattagtacaattaaaggaaataatagaagtctaatatgtgatagcatcagaaaccatccaaaagaaactagaactctgtaataataagacaatggctgtataacaggtttttcaattcacactagaactctgtaataataagacaatggctgtataacaggtttttcaattcactgaagacaaatataactaacaaaaatataataaaattaacttttatatcttcaggattggaatataaatggaggcaacaaatataccataattaacatttactatgagttaaattgattggaattgtgtttgaaagcacaatttctgtgggaaggacatataaaagaagcaactgtcaagtttatgctaaccatgaaaactactgaaatgaaaaaaatctaccagcaagtatgtcatgttaatgagaaaaactatggttaagacattacgtttgagttaaaattgcaatttgtatccttgaattcttgcggacagtgaccattaatttatagtattttaatccagtagaagtgtgatcttaccaagacattgttatcaaagcagacatcaggcccttttcggtatctgggttgcttaaccatgtcacaaggatttggaccgtcagctaaaagagacttgttaaggaatctcatgttagtttttttcacatgattaaaaataaatacaatgcaatgtatttcccaaaacatgtgagagagataacttatacatcattactctcatccaacacaattcaagtacatagggatttaaagaactaaattgtgaattatccttttctggggcatgtgtagcataattattcttgacattccaaccaaattttgagtgaggaatcgattctgcctttgcgaggtgatcagagcagtctaatagttttctctttatgaatataaacaatgtgacaagattcaaaatgcattaagatggttttcctttccagatagctctgatgtcaaaggatacaagtctgctccgcttgtatgagcagtcgtgtgtcacatggacatgtccctttgctctcaaccattatgaatattaagttggtgttcataagcttttctccatgaaagattctgcaaaataaatatggtatcatagaaaatgagtatcttttccaaaataaatggaaatctttcaaagattcttacatattaaaatgaaagacaaaatatgacatctgaaacagaaaccattcccagcacaataggagtatgattttagaagaaaaaaatgcttcatttattagcatgaacgtattacctatgtcaaatgaataaaaaaattgcaatatatgttttatgtgtgaccattttaaagtattaatcctcattgcaaaataagcacaatttagttgttgatgtacatagaaaaaagtttttctttacacatacaaagaattgtgatgcttatgccaaagttgccttattttacagataacacaacagggaatacaaaaatgtctaggcatcttgcccaacctaagggcagagaaaagtctggaacagtgctattaagcaaactttctgtgaagatggaaaagttgttcgcactgtccaatatggtaaatactagccactcgagggtattgggcacttaaaatgtgacaagtgtgactgaggcacaaaattttaattctaattaatttaactgtaattgaaatttcaatagccacctataggtggtaactactgcactgggcaacacagacatggacagaatcaagggttttgaattccatcccctgttttgtccacaccttaagctgctcttactttagtaaccaacataaaaaatgtaaatatatcactaaaaaagtaatttctttatcattatacattttgcagaaaagtgggattttctttttgccctgttaagctttgatttccataaagcaaatcaaaaggaaagtatgatgcaatttaacatcttggttatactgaccttcttcactttacaatttaacttacttctttaagcacaccaattgctcttgctggatgtcaattaataaaaggccaatgtctgtgaaactctgatgtatccaataaacatgccacaatcccatttcctgaagtccatagcctgatatgctaatctcctctaaacaagacagtctgctttttttctgagttcatgcttgactcttccttccctttcctctcctctttatatactctacctcctccttggagatagaggtctgctaaagaaagtcataaaacatactgaccacgtctcctaaaaattcatgataggttgcttagcccctcttgcaaaatttttttttttaactattctggcactttcataatctcagattacctcacctcctcctatttcttcttccgctatggtaacatttcttctagaataatcttccctccacctctaaaaacaaagtgtctctactctgtgctttgtaagctgtgacttgctgctctcctctcaggaatcctgtggcattaattattactttcccctcaaaatccccatcttgcctttctcctctaccctcattacaacaaaattaaattctccatctctttttaaaagatattttatggatactgactaacattaaccatgacctaaaaaaactgtatttttcccagttccttcaaattcaaataaagataacattcagttcttcaagtcagagaagactagaagtaaaaacaaaacaaaacaagactttttttttgtaaatctgtttagttactatatagaaaaataaataatatttggcttagaattatttaaattactaatatatttaataactttatattagaaatttttaatatgggttattttaggaaaaaaagttaaaatataatcaaatttctctatgttctgcctaaagagaaaggaattatcttgatcatgtaattattatagttgaagaaataacagcttatcaaagttagaattttaaaaattacaaattttaaaagtctacagagaaactaaagattgctgacattttcagcttaaaacaattactcacatctctgactccaacacaattttcagttttttctgtaatgattataacagtatatacaatttcttaatgattataacagtatatacaatttcttaatgaaataggactactcctgaaataaataaattacctggaacagtttccacagtctaatacaccactgaatgatttactgtcgttatcgaagaaatactgggtttgttcagtaatgcagctctgcttggacagggaggccgtgaagtcatcatcctccatctcaacttgggtggcgggggacggtgtaaaaacaaagaacaccattaggaggggtctctgtagtcactcccctcgagtcttcacttctcacagagcaaaataaacgtataagaccaggacccctcgactggcttgtttactgctgtgtaatatcgtggcagcccgtaatagatgcctgataaatatcaagagaataaatgaattcaaatacaagatggctatgagatcaggcccgtgtgacctaggtaatttctaaaacattaggaaaggttggacaaaaagtttctagctctaaaattatgagatgggtgacctgttttctctttcacacaaatattctctgaatttgttgaacttcaagcacatcccaaaagaaaatttttattgttatggcaatgacaaggtctgagcatttacatacctgcctcaaggagtcgtggaaaggtcaaactcaagagaaactgctgtagaatagacctgaatttttcaaataaaaaaaaaataaacatctagggaaaaaatgtgtttttacatgtacccatacacataaatactgtttccctttatctttttgggaaagaaagtcttggagtgtttttatttaagtattttcaaaattatataacacattgtaacctttttgtaatgtgtaaaagaagtcatgaaatcagaagtgttcagatcttgttcaggatcaagtgggacacaatgtgtgaagaaacctaacaggcaatgttatcaagcagaagagttcactctaagagggagaatgtctgtttcagcgcgtaggttttcacattcattacgtctccttattttagtttttaaaaccatttgttttttgggtttcccccgcccccaacaaagaaacaatgctgtttataccatgggtttgaatttgttaactatttactttgtaatatagaatatatttgtaaatatgtaatgtaactttcatgaaacaaaatatacatattagagagatacagcacatttcagttttacagtaactgacaactgagccaaatttctagaactgaatttagtttaaaaaaaagtgggggtgggaggggatataggataaagccaagtatttcagggtcatgatgaaattttaaaagcctactgaaattaatatataaaatcacatcagaaaataccatttttcagaataaaacagaattttctaaatcttttaaaaactctcaaaattttaaaatcttttttgctgctttaatgatatagtcacttaattttagctgggcaaacctcaacatcaaatgaatattgtacattaatctacatggaatagggctaacaatacagtgtgatgatacaaaaaaaaagattagaagggagagagggaagagggagatcatggattccagacgtaacaggaggtttagttacaactaaacaatgagaaatgtgatcttccagaccttccacagtgccacaattgaccatttaaatgtcttattttcataggttgtagggtctacaggtgagggttgagggaggtttggaaggtagcatcagtgaaaagaaataattagatccatgtcggcaacctgatgcccctaaaacaatactagtccttgtatcaatagtaaagaggtagaaggttgccatcatgccatgaatttgatgcatgtagacatccaactgggatattaaagacaaattgtaacttcttacagatcaatacacctaaaagaaattagtgtaatgtttttataaatatttaatacaaatgaaaagagtttcaatagatatgtagaggaaggaagactctaaagaggctgaagtttacatccgcataacattgttttcatatgagaaactgaataatggtaactttatagtgttcacttaggaaaaactataaatattaccaataggtgatgtaaagaatgaaaacaacttaactcccttaataaaaatttgaatatcccctaaatccatattttcatcagatgcttttttattttacaacttctttctttcattaccaataaaactaaaattttgacttaccaggcagcagcagtggcccaccagccaatttgtaatatgtctgctactgatggctataaaataaaataataaggtcatttcagtagtctacttgatactgaggacacttgagtaccccttgagaattgattagaccgtggatattactgaccacatatgctgagcgatgtcctgctccttgttttggtgcagcaccgggctcacatactgactgataatcataagatttgttaaaagcataaactgatatattaaccaggtgtctcatcaagctgggatcaatctctccaaaaaatcttccaatctggtgaagaaaaaaatcataaagcaacgtgcacttaaaatgtaagccaaaaatgaacacgggaatcaccactacagtgaaaagaaataatacaaagaaactgaactacaactgaggagcttaaaaacaaaagcaaatgagaaacgtgtatatgacactgtgaacaaactaaaatgagagtaagtgttctcattactcagtggggctgtgtgatattttatttgtggaaagaatggacacacattactaagcattaaatcacaatcaaatgcttcccagatgaataaaacagggccggggaatggagaggtataagtggaagggtacaaagaagcagttatgtagaatgcataagcctagagattcaacatacaacagaggactgtagttaataatactgtgttgtctaccagaaatttgatgagagtagattttaagtcttcttaccataccgcaaaaaaggttaacaacctgagatgatggatatgttaattggcttgacgcagtaatcacttaactatgcaaatcaaagcttttttttgtacaccttaaacatatacaataaaaaaaagatcaaatgcccccctggggaatggaaaagtggcataaatgagagagcaggctggcctagaaaacgaacttgtaggggctgtgatgaactggaacaagtcccatctaaaggggcaatcatgagtgaatcagctccaccccataaatcctgtcatccagaaaaaaaacaaacaaagcccagggttgagatatttttgctttgttttttcaaaagaaagaagccaggaatgcagattcagaagtgaaattagttggcatctacttcaaatttgttaaaaatagcctatgtgctgctcatttgcaggtttgagactagaaatcacatcagttttaacaagctatatattaaattagataccatcaactgacaaatgttgaagtgaaagttttctaaatatcagaaagattaaaagttcatgtcatgctaaaatccttaactgtatgttttaatgataccagtactaaaatgtaaaatcaaataacataaaaactagacttagcatgcatttcttaatggtttacataacattaagcattttacaaattattgtatgacagaaataaaacaactcatcgatttctaaaacactgaaagaggttttgtaatgttgatccgggaaacacactttggaaagcctaattccctcttatttgaggtacatacctgattagtataatcatcatgatttgccatcagaagaaacccaccatcatccagaatcacacaatccattacctatcaaaataaagtgaacagttaacacatttttagaaaggttaggaggctgcattgtctttaccccattatatacatgattagagcaataaaaatagaaaattttaaatgcctatcttctcttgaacatatatgttcattaaattctggtgaaataaaggcatgcatagatttatatcaaaccatcaggcttgataatccaacaccaaccatccacttgagactgtcaattcagtctgaacaaatcagaagagcaaattagaaataatctttttaccatttccgggtcatctaaatgatccagaaaactggatagagaaaattatttaataatgagtaactgatttaaacacatacttaggattttgacaaaaagatattttaaaaaaatatcattttagttgtcctgtttcacagacttaaaacacatcagtactataagactatttataattatttcatattttagattaaaaatatgtagttggataattggagatttaaaagcaaaacgcaaaacaaaaaatgtccatggttaatacttacttcaccctgaaacacaggataaattcccacctagtttaaatcatgttttaatgtatgaaaatcaatataataatttgtattgaataaaaatcacaaataaaaacatggttttcaaagttgaggatgtaatgcattgcattttcctaatgtggaagcagtttattactaaaatatttgctcttaaaacagctactgcatagtctatgtgaaatagataagttacaaaaatcattaaaattattggctcataatttcacaggagtaggagtgataaagacgatatgaaccccctgcttcccttggagatatacagacacacaaaagaggactggaagaaaatattgtttcatcattgttattcaatttttagaattatttatctagtatcattcttagagcatcttcaacttttgaacaaagttcacatttcctttttcaatttctcaaacagaagtgaaagtaatacaagacaccttaaaactcaatccatgtaactataactttataataaactgtaatacttccaggtttagttaaaacatttttcctgtaactatataatacagtgtgaacaaatttagagaaagtgtgataggtgagagaaaactgcattgataaccaatagggttgctttggttagaaacttcctatccagaaatagagctaaagataaatatgtacaaaagaatgtaacacagttgagaccgaagagaaccatcatattgacatgaccatttttttaccttccaaggatacatacatatttttaaaaattcaagcactttacattcaaaatcaaaagcatacaaattcaaatgaatatattatttcacatttccatagaattttttagcctttgattaaaaaattcctgcatattttttcatcactatagtcttagcaagagtaacacaaggaaatattgtactcaaaagtgattttaaatagttttcttacgtcactgtttcttttgcagtcacaaactggaccagcacactgaaagacaaaaatgcgattatcacctcacttttaaaagttggattttaattatattattaccatgttataattagaaattctgaaataatttatccagtagaaaaataagattaaacagtctagtctataagaaacaaaagttttatcttattagacaatgtcaatcaatatataaactagcattgcatgttataaccttgaaatacttctattacatattgactaatttaaacaaaaaaagctttgaaaaaataggaattcagaattctacttcagtgtagtggtattgagaatgtatttgccactgtataaggaccttatatttttttctattgaattttgaaaacattaaacatagcataagaattttttaaaaatatcttaccggatctctgattgaggttttggtgaaattctctatccaggaatttacatcaattttaattccaacaactgaaaaattaatttgaattaattcaaaggtataattagatgtaatacaacctttgcaatatgacagttattttgatagcaagtatcagactatagtttattacagaagttttagttttgtgttcattaagaaataatgctaatagctcttaaactattacataaattgtaacatattcacaaaagagtgtattcattagccacaacctgaccaattaactaatacaataagctaaataaaaaacagtagtgtcaggagagcctcataaacttgaggtcattcaaacggtatattttaagatgtttccctaaccccaccagtgcttgcagtaggtgcttaataaatctttgctgaaagagtgaacagatgaatggatgagtaggtgggttagtaggagagtgggtgaataaatgaatggctgagagaataactgatttagtaagtaattgagcaattgagtgaatgaaggaataggtaagtgagttagtgagtaagtgatggagtgaattcatgtaatagatccgctgatggggtaaagctgtcctcaggagcaggaaggctcaaaatactctcctttaaaacttcaaacactgaatcatacaatcaaaaaaactaatagcttttactttattgtattcactcactctagcccacttccgatcctcattaatgctcacttttactatgtttgtttacttgcctatttttccaaaaagtcatttttctatatattttatagcaagtttttaactgagccctacctaattcactttaacagacgcctactagaatatagtataaatatgccatatttatcttttccctcagggctggaaacttaacttttttgtacaaatatgtaactccttggccatataactttgtacgtattttaaagtattaagagagacttctggaggtgggttgctaatccaacattaaaaattttgattattatactaaattgattccatcaatttgtgtcagagtataaacatacacactgttttgaaaattcctcaaatctatgtagtatcaatttgattttatcccaacttcagaggtaactagtcatattttatttaatttttttaagtgtgcatgcctttattttgtttgacaccttttgatgaccttcttgataaacattgccagtttataatataaatgccaagtaacatttaattttgattgtgtttttgtatttaatatttatccttacctgcaggtttaagaagtttcccttgaatatatatttctacagctttgcttaccataatgcccgattcataggcaccaggtccactttctaaaaaaaaaataaataaataaaacacctatcaagatatattgaataataatattgattttccgtcattagatacaaatggatagtattttgcttaaaaattctagcatctacaaactataaaatgtttgtgctctccttcctctcttcttccgttgtatacactaggctaactggtatatccatgaattggtttgtattaattgattcggggacattaattagcttggttgcatctgctttcacaacataatgaatacatgccaaatctctacttcacaacatttgttaaaatattaagtagttctgctgaagtgaagtggaaagattgatcctggatgcataaaactgactttgtcttttataagacgtatgtcactgggcaaaactttgaaattctctgaacttgtttccccatttaggaaaatgaaggtaaatactacctatgtgcaaagatgttcagggattaaattacaaggtttttgggaaataagtcaataaaatattttaaaagataagctattattaattgtataattatattttataatactgataaaatgtaattaatcaatggaattactctatttaattccttaaatgtttttcaatacattttcagttgtaatatgagggattatctacatgtgtttctatttcttatgcatgcctaacagatatgctatctctaaattactggaagactgtttgctgtgtatgcattttgcttcttcaactaaatgatgtttcttttctattttcctaatgccttgcaaatactctatttttaatgatgactattctgagtagttaacataaaatgtagtgatttggggggagagcagatagtagcagtaatttattatttaaaaaattgagaaaagctgaattccaaagcaatacttactgttaaagtagggagcagtgaaaacatagttatcattatctaggctccttttatagaagctgtcctcatatgtctctgggttttcttgccaattttctccagccctaaggaggaaatggctcatcatttgtattctttaatctacctgataacctactttatcctatgtggacttgctgagctttacagatacgcctacatctcaggtatgtctaaagaagttagtggtaattgatagcataactgatactcattactgagcaatgcatcagcatagcactaaattaagaatcagaaaaagctaactcctagttttactccgttgtttactagtcaggtaacaggacaagtaagttaataggtcaattaatgttagtaagcattggtgcctactcagcctacttcatggactgttacgaagataatagagataagatgcatcaaagaagagtgaaagataataaagtgctacataaatattgctgattggttataatcattgtgttcatttcactggtttagcttgtatctacaaagagaaaaatctctttaaacgtctcttaaatgttgtaataaacatatttggcaagcaaaaacatcattgaagaattttataatgtcatttttcagagaaataaaatcttttaataatgtaaatactgtaaacaatggctccaatgtaatctaatggcaatcagtttatttgaagaatggcttccttaagcagtaatgtacaaatccttggcgcagtcttttgtaatgtacttgtttttacagatgttatttgaacttactctttgggataaactctggtaatcccaccatcagtcacaacaaatcgtgctttcactcccttgctgaaacagaagacaaaacaaggaaatgttctattgaacatattctaaaaaacaaagttaggtgttggtgatacaaagagaagtaagtttaggaagtaaaggaaatatatcaatagatacacaactatgttttaataatttaaatatctattaaatttgtacttgaaggatgtttaaggaagacatctcataggaaataatgactgaggtgcattttgaacatggagtatgaattgacagcaatgacacagaaagcaggaaggtatcacttgtagagaggaatgtatacataagggaaagctaccagagatggctggtgtttggtatagaaaaaaaacgtaagacaaaaggagagaaacagtaagaagtaaagtttcaagtgcaagttcctcaatggtcagctaatgaatgattttgaattccatcttagagagcttcacctgtatcttgaacttagaactgcattttaggagttagattctggccaatatgagttgtatggagaattgtctagaagctgcatgtggaggaatggagaacactaaaggcagaaaaatcagttgctgtgatttcttagaaatgggatcttagggccttcattatgaggtagagaagaaaacattgctaggagaaatatttagcatttagtgactgaaaatggggtggagaagagattttaaataagaatcatactcagattttctcaactggatgtatggtaatgctattagaaacccaaataaacactgactagaaatcctactttagcacaaacagaaacacacaatcatgcccatttaatttggtgtattcaccctgaagtgtatgtgcatgaaaagttgagtaatagcagacattagtactgaaaaacacccacaactgaaaatgcaagttgtcaacaactgtatagtgattttcttgagaaatattaaacattattaatgaactgtaaatttatgagattcatacccaatttccacaggagaaactaaattgaaatgcagaatacatatttttattaataagaacaaatacttacatatttttctgcttactccagtaattttggacaagttcatttgtaaagcctgcatcaagcaagactctattaatcaaatccgcgttacctaacacagaaaaagatcatcagttacactcacatttctaaaattatgatcataatgaaaaatatattttctatttccaaaagcaatttagagtagatatttctatgaattttaaaatatattccacattcattttctttgtaattttaatattgttcatcttgcctcacagtttttcaggaaatgaatggatttagtagtagaaaaatcaattctaaatgagccaaattattttgtaaactttatcaaaataagaaataagctatgttaagaaacaggaaatagtccttcttttgtgtttttgtttatttctgtatggtagcatggcgattcccaaccatcataattttatgacaatttaatgtatacacacataaaattttatatatgtatataaaatttatatatatagaaacagaactaccactgaaattatcaagtaaaaacattcaacaaaaagttactgtctactttcactttcatttgttataagaaaagctattttcattcttttctatcacaaatatcaaaacataggataatcttggagtaaataagactatgaaaaattcagtgccgcatatcgaggagcaaggaatggaatgagcatcacagagcagtacaatcccaagaatgtttttgaaatctactggtattggtcaaagaaccaatacctaagtagataataggttgtcatttctagaataactgaagtgcatattagcccaagtttaaagataattgaggaaacaggtgatgaggatcaaaggccaattattatgtattcttaaacaaaaacctctgccttcttcccattctccttgttcctctaaacccattaagctctgaaataccctaacaggtaccctctgaaattgcacatttacgacaaaatttgactttttcagataaagaatatatgttcttaacatcctattactatacaacatggtggtgagataggctggaaacatttttgttgcttttaattattttaagttaatatatcttacacctgggattaaaggatcaatgtaatccctattttggagtacattttaattcattctagacactcttttttactatattgttttagaaactgaatcatttaaaaaacagttcatttggaaagtaaatgttctaattgcctccaatccctttaggtaaaacaaaataaatagatacagatataaaaaagaatgattccaattttcatggtgttctgaaaagttatatgttaggaaaaacatttctgataaactcatttttgcaaggaatatgagagtgtttcataattttggtatccaattaaaggaacattcaacaatcttattacagttctctcttggaaatgcctagtactcattaataggaaataaacaatgacataaaataacatttcaaaggcactggctcagtctcagtgagcttgcactgagtagaaaggtttggaatcatcatgttaagacatgatcaatgtaaactctggctcccatgacaggttttcagagtggctcactgaagccgctaactaatctgtgctaaagtgaaggagctaggaagttatttcttctcatatgcaataaatcgaagttaagagtcagctttaagaaagcctttgcctttttgataactgataaagtgctttgacccttcctaatagaaagataaataattgaaaaacaaaaagaagggaggaggagaaggaaaaggagggagggagggagaagagaacaaagagactcctctttgagagagaaccaaaaaagtcaattatgtgtacttattcttttttcaaattttatttatgaagataaattttgccatgaatttggttttcctcttatttcccatttgtacggtatttgttttggtagtgcttttataataaatatttttagaagaaaaaatgatttagattttttaatgatttaaaagccaagaatccataattttctattaagcttagagtatgaatgatgcaaatttacctgaaagacaaatataatggttaaaaactaattactaattttctgttgtctattttaatttgatttacctcataaatgaaaaattacagaagcataattttttaagacataaagttaacttgtgatcaaaatagaatgtcaggaaggaagaaaatcattaagtgatatttctttatacttcggtttttattctacccatattaaaactcattatattatttgaagcatataaataaatttataaaaatgtacgttttcctctaccaggcaaaatgctataaaaaaaccttcaaaagatcattcaaaattaaatttcctaaatttgagaggagctaacatgagcgtgccatatttacgtttaaccatttgaaagaatatattaccttgttttgaaaatttgatttaactaaataatgaaataacatttctttagtttgcaaaattaaggatcaaattgttacattttactattaaaaagttgtaaagtaaataaacaaccagcacaatataaagtaatatgattatcgtatcctatgatatactataaaccaatagaaccacactcaagcaatcattttgaattaatgcatacttacatgatgggttgtttggagtttttctatcaataaactcgttgaaatttaaaagaaattcagtgttattatccgatattttcaggtcattgcagtaatctctgaaaaaaaaacattttgagatattagatattaaaatcaaaactttacagggtaattaaaggtagtgaaaacactattttttttttttattagccacaagactttgcaaactattgagcttcttgttacttccatttcctcacttctataatggaccaatactttaccagtaagtggtgattataggcaatatgaattaaacgtttggcctttggacagtaggtgctcaataagttttggtgtagttatactattatcattgtatatcttagatttaggagtctcatatagcaattaaaacagaaatcttggggcatcgggggcaaggggagggacagcattaggacaaaaacctaatgcatgcggggtttaaaacctagatgacaagttgataggtgcagcaaaccaacatggcacgtgtataccaatgcaacaaacctgcacgttctgcacatgtatccctgaacttaaaataaaaaaaaaattgcctggagttacacacatatacaaacacaactgagtggacataaagctagtgaaatctgaataatatcagtggattgtgtttatgtcagtttcctggttgtgatactgtgttaaacttatacaagatgttgccattggaggaaactgagtaaaaggtatataggttctctctgtattatttcttgcaactgcatgtgaatctatgactgtctgaaaataaaaatttagacaataaaaaagcccagaaatcttaaagttcattacatgttaatatattttaataaaatattaccattattttaaaaaatattttaaaaagtggcaatgttttacatatttgcaaattatctttaattcctgacaagagaagacaagcatgtctctgcaatcaattgcaagagtttgttttggtctatacagaaaatttgtcctcacagagacgagaggcttgtttttcttcagatattgcggctgttctgtttttgataacatactgaaacttgtttatttgtaattcattgatgggtagttgtaacatggaatctgaaacaatattaatagtttttttgccttctgttacattaaaattccatattctttcttatactttaaatgaatcttttaagcatccgtgattttgtaaaatcataaactggttatttagaaaatgagttgtgtacaacttccaaataatgacacattatacaatattgaaaatttacactcattattatcttcaactaagtaagtattgggaatgaatcatgtatacaactttcccaaaattctaattttcgttggaaagctcagtttctgtcattggcagcaaatactcttagttgttttcttcgaagtcaaaagctcatctgatttatttttgagaaactatctgctggctatccaaatctgaataaccatagttctgtaatttgttctttcaagtaatgttacattaaaaaaaaaaaagcagaaagcaccttgttcacttcctaacacaatcatacaggtcctttatttttttgagacatccaagttactctgggatgcagtagcacttctagttttatcacatataatattaaaagacatgcactcaaggggaaaacttcaataaaatttataattctgaaatcaggtagcgtgatgtctctagctttgttctttttgcttaggattgtcttggctatatgggctcttttttggttccatatgaaatttagttttttctaattctgtgaagaaagtcaatggtagcttgatgggtatagcattgaatctataaattactttgggcagtatggccattttcatgatattgatcttcctatccatgagcatggaatgtttttccatttgtttttgtcttctcttacttctttgagcagtggtttgtagttctccctgaagaggtccttcacacacatcccttttaagttgtattcctaggtattttattctgtttgtagcaattgtgaatgggagttcactcatgatttggctgtttgtctattattggtgtataggattgcttgtggctgggcacagtggctcgcgcccataatcccagcactttgggaggctgaggcaggcagatcacgaggtcaagagtttcaggccagcctggccaagatagtgaaacctcgtctctactaaaaatacaaaaaattagccaggcatggtggtgggcacctgtaatcccagctacttgggaggctgaggcaggtgaatcgcttgaacccagaaggtggaggttgcagcgagcagagatcatgccattacactccagcctgagaaacaaaagcgagactgtatctcaaaaaataaaaaaaaaggaatgcttgtgatttttgcacattgattttttatcctgagactttgctgaagttgcttatcagcttaaggagattttgggaagagacaatggggttttctaaatatacaatcatgtcatctgcaaacagagacaatttgacttcctctcttcctatttgaataccctttatttctttctcttgcctgattgccctggccagaacttacaatactatgctgaataggagtggtgagagagtgcatccttgtcttgtgcctttttcaaagggaatgcttccagcttttgcccattcagtatgatattggctgtgggtttgtcacaaatatctcttattattttgagatacgttccatcaatacctagtttattatgagtttttagcatgaaggggtgctgaatttcgtcgaaggccttttctgcatcaattgaggtaatcatgtggtttttgtcattggttctatttatctgatggattacaaggctacagtaaccaaaacagcatggtactggtacaaaaacatataaaccactggaacagaacagaggtctcagaaataacgccacacatctacaaccatctgatttttgacaaacctgacaaaaacaagcaatagggaaaagattccctatttaataaatggtgttgggaaaactggctagccacatgcagaaaacagaagctggaccccttgcctacaccttatacaaaaattaactcaagtggattaaagacttaaatgtaatacctaaaaccataaaaaccctagaagaaaatccaggcaataccattcagggcataggcatgggcaaagccttcataactaaaacaccaaaagcaatggcaacaaaagccaaaattgacaaatggtatctaattaaactaaagagtttctgcacagcaaaagaaactatcatcagagtgaacaggcaacctacagaatgggagaaaatttttgcaatctatccatctgacaaaaggctaatatccagaatctacaaagaacttaaatttccaagaaaaaaacaaacaactctatcaaaaagtgggcaaaggatatgaacagacagttctcaaaataagacatttatgcggccaacaaacatatgaaaaaaagctcatcaccactggtcattacagaaatgcaaatcaaaaccacaatgagataacatctcatgccagttagaatggcgatcattgaaaagtcaggaaacaatagatgctggagaggatgtggtggaataggaatgcttttacactgttggtgggagtgtaaattggttcaaccattgtggaagacagtgtggcgattcctcaaggatctagaaccagaaatgccatttgacccagcaatcccattactgggtatatacccaaaggattataaatcattctataaagacacatgcacatgtatgtttattgcagcacggttcagaacagcaaagacttggaaccaacccaaatgctgatcaatgatatagactggataaagaaaatataacacaaatgccccatggaatactatgcagccataataagttcatgtcctttgcagggacatggatgaagctggaagccatcattctcagcaaactaacacaggaacagaaaaacaaacaccgcatgttctcactcataagtgggagtcgaacaataagaacacatggacaccagggaggggaacatcacacactggggcctgttggggggcaaggggagggagagcatcaggacaaatttctaattcatgtggggcttaaaacctagatgatgtgttgataggtgcagaaaccactacagtacatgtataactatgtaacaaacctgtacgtcatgcacatgtatcccagaagttaaagtaaattttttttaaaaagtgtatatatatatatatatacacacacacacacactgttcaaaacagcacatatatatatatatatatatttatttatttatttataatcaagcccataaagggcttaacatatgttaattgaagtggacattcattggcctgtcccacaagccaaatactctcccttctcaagtactttctccttccctaaacacgtaagtaaatttcgatcttctagtcagctgtattgatatcattcagctataaaaaaagtactgatacgtgcaacaacatggatgaaccttgaaaacatcatgctacgtgacataaggcagatacaaatggtcacgtattgtattgttccatttatacgacgtgtctagaacaagcacatggccataagagacagaaaatagattagtggttgtttgggtctggggagggttggggaaggatgggtaggtaacatttaaggttacagattttctctttatgatgatgaaaatgttctaaaattaactctagtgatagttgtacatatatgtaaatatattttaaaactttgaattgtaaaaaaaaatatgaaatgtgacactgactacagaaatggttcatacactaatacctgctggattaaacaaaatccactgcctatgaattaggaattagaattgagagatatatctatctttctctatgtatctggattctaccctagtttccaccttgtcttatagtgaagctgagaaagccaacatgcataatctgctacttaataactgggagagacaagggaagaaactgtagacaacaacacagacctcagatggagagtcttgccaacatagcaggcctaatttcaatctcttcctaaattgtttgctatgttaatattctgcgggaccctgtttttgttgtttttgttttttctagctaatgttctccttaatactgagaaaattctttctagttaaagtgggttaaagttgttctcagtaattcaaagtaacttgaaattaattaaagtgacttgtgtccaaaaactactaataagattgcaagtattattagtgatacaatttttaagaatattctttatatatttacagattctccagtcaccaagtatttattcagcacctactgtgtgccagcaatggattcactattgggtattgaatgttaagtcaaatagacacagtcatggtctgttgaggaaagtaaataaaatgtggccagtgctccccaagagaaatagagaattctatgaagcagtcaggaaggatgcgtataccagtgaagaaaggaaagaaatccccacattgaggaatttttaagttgggatttcggagggagcgggatgcatatgtatgtatgtgtgtgtagtccaaaagggaaaagagaattaatggaaaaaagaaggtaaaactaaaaccaagcaaaaaaaaaaaaaaaaaaaaaaaaaaaagaaagtgcatttaggaactgaaagacgttagtatggatgaaatttagagtacgggtagggaaactttccctgacagggccatgtagcaagtgatttaggcttttgtggcccataaattctatgacacgactactcaaccctgtctttgtagaaaaagcagccaaagacattccagaaacaaataagcatcactgtgctccaacaaaaatttatgtttaaaattgatagctgatctacaggatgtagtttgatggtccatagtttagagtgtgggggaccacactggtacaccaggacttggtggaagagcatttgaaagctataatataaagcacagataatcataaagacaatatacaatcactggctcgtatttagcagatgagaaatatgatttttttcacattttagaaactctctggttacagaacagagacagcattaagaaatacagggtaaatatgaaagtagggagatcaagtaagaggcaaatgtagtagtttaggtgagagaaggcagtgacctggattagggcagaggcagctgagattgacagatacacttgatactcatacgacagaactggcaagactggtgattgattagaagtgagatacaagagaaaggaagcagagaaggacaactaacaggtttcaagattgctcgtttgggaggatggcattttctcctctgaggcaacataggtagaactttccaaaggaaacaattatttataagatgctaaatctgaagcacattgaagagatactcttgtctggtttccatgagatgtgtctcatattgaaatatgtaaagtctggaaatagatataatataggattaaataatataatgcaatatcaatgaaacacatatgtctttgtctctagatatttatggccatcatatagatttgggaattatgaacctaacctgtaggcagagaacacatgggtggcttgtggtctgaatgcagtctcaggtaaaaagacagcctaggctagcatcctttgcagccttcttatatgagtgatcagcagaagaaatgaaactcatgaaagagacagtgaatatgcagccagagagggagtaagaaaaacagaatagtgtgtcatcaagcaagagaaagcacactgtcaaaggacagcgtgatcaacagcgtcacacactaaaggaaattcaagcaagagaagcttctcaaggatacgggcattcaaaaagccaagaataggctttgttaacagagatttttcaaaaaacccatattccctacgttaaagtagaaacaattcagaaatatccttttgcaagaattaaagggtaactcagaacaatttatatgcatctttgagtttttggaataatttaagaaaagtgaaaaattaacaatccaagcttctatgtaaattgttcccaataatttggcctagattaataggaattatatttgaatattatatgtgtctgtcatggaataggagtcaaaaactgaggaaagaaagaagaataaagaacaccctgggactactgaatagtttcaaataattacaagaaaactgagatggagaaaaagatgtacatgcgtgatgaagggagattatatgagagataaataaaattgggtagaaagaaatgaggtgcatctaaaaagctatgtaaagcaatgccactgtaaacatgttctcccagaaagttgaattagaccattaaaaaaatccattattatgttcattctacccctacgtgtatagatacacataaatattggtacatatatgtgtatatatgtgtacatatgtgtatatacatattcacaggtaaaaatacacaattttctattactgttggaagcactgtttgttctacaagagcaaagcctatgtccatcttattcccattgtgtcccagagtctacattgcttagcacatagtaattgcttttttttttgagatggagtctcactctgtcatgaggcaagagtgcagtggcatgatctcagctccctgcaacctccgcctcctgggttcaagtgattctcctgcctcagcctcccaagtagctgggactacaggtgtgtgccaccatgcccagcaaatttttgtattttcaatggagacggggtttcaccatgttggccagatggtcttgatcttttgaccttgtgatccaccagcttcggcctctcgtatttgaatgagtaaagaaatgaataaataaagattttgtttcagttttaaagtaattatttcctttgattccataatgtgatatggaactaacccagagcagtcttgactcaattctgaactactgttgaaggcctagctactgatagaagatgtatcaaaaatacaacaaaaccaaccttggtgctatgaatgtatagccagattcttcaaaattatctggcttcagggtttccgaatctgcaaagataatgttacaggattagataggtaattcagagtatatatccagagattctataacaataagaaggcatgagaaagattacctaataagaaaaattgaaaatagagtacttacatcctaaaattgaaacatatcaatgaatataaatgtcctcaatgcttcccaaaataataaaattataacatggattaacttcataacatggatccccacagttatttcaaagaaaatgctatgtctataattttctgatctaaccctactataaccgaatatcttttaaaaagtgattgatatgaatgttataccagaggtattttaaagaccaattatttatataaagtttaccaatattatgatccagaaaatgatgttaaaaaactcattaatgcctttagtgagttaataacattcctcatattaggtatgaattagtaagtggaaggatacaaaacaaagcttcttaagtccaagaaaaaaacttgaatgtgaaccagcttgcatatgaaaacacagcatattctttctaccatttttttgctgctaagttttgagtgatcatgaaggaaaatttagcaaatgagaagcacagaggataatatccaataggaaggaaaatatcagtggaaatgtcaagtgtactaaacagaaagaagttgagcaacaagaaaatacttgcccttcattttgcccttttttgctgtgaaaatccatcagaaagagaaagcagggaaacaaaaaaaaaagagggtaaagcaaagggggtcataaacaatattttattcaatgactttcttgaataaaaatattgtgcatagatcaaaggttcatttatgtacagctgtagtctgaggaaaaaaaagacatattttgaagactggatagtatgtcctatcaattataactagattaccctctctgtactgtggttatttcaagggtctgttttgcaaagtgattaatgcaggtgtaataccaatgacgtcaggctataaacataagcatttactaatcaaagactcacgagttatcccctcatttatcaattgaagaactagctcatgcagaattgctggttgtgaaaagaccatcatatctatctatcaagtgaaagtggaaatataaatgtactatgtataatgcacagtgaacaccaggcctgatgcgggcaaaaaagaactgacagagaaatgaaagaaactgtagcttactttaagatcagatgtaaaatatatacgtatatttttggtattcttttgtattttacttcatcctcacagaaaaatttaaggttgttagcaataatcggcagtgtgcaaaggatatgatggtcattttactttacaaaatctagtcacccaaaacaaaataaacaataacttgaagtatgcactagtattaattactctacattccaaatgaggcttaaaaaaattaatccatttgcattactgagacattaatttggattacgaaaagaaagttaattgccaaaccaaagccaaagaccagtgcaatttaatttattcaaagtagaagaagatgtgaagcacaatattattctggccaaatgcaaaataaataaataaataaccagaaacaaataaaaggaaagaaaaggaaaagctttactagcacagtgccatgagagtagagactatgttgataagtagcatgtgaaacattttgctccagctagcagacccttaaaacgacagcaacaggacacagcactgcaatgattctatgagcacatagcaaggcagggaagggtggtggggactgccagtgagactggagtacctgctcatattctatccatgtagaatatttcttgttccttgcatgtttggaatgggttagaatcattgctgtagatttggtaataacacctactaaaatatttcataagccttgggtattccaaaatctagacgtatttaaacatctgatactaggagataacaaatggaccctgaagtcactttcacagtacttacatctggcctgagttattgtctcttctagtttggcttttatatagtaaaaactgtaggttggtaataccaaggccaaactgcaatagaaacaagagaagcataaacacaaacaaacaaaaatgaaacataacttaaaaaaaagacacatcaagttcatgggaaaatcgaaagatcttcctcatgggaaggaaaagacatattactttgacaagaaaatgcattcagcaaatacagtacttaatttcagtcttgccatccagagtcatctagctctctacattgtagggaatcagaagagacaagtggaaaataagttcctgaatgaacccataaattagccaaggaaggagtgtcatggccccctactatgtttccagaaaattatattaaattactttgaattttaacaaaaaattgaagaacattaggggtatgtttaaacaaggtaaatacataataccatttggacacacttccttaacgtattatatataatgttaaagtgctttgtataaaatggacactattaaaatacaaatggaagagttactattatcattactttttttttttttttttttttggagacaaggtctcactctatcccccaggctggagtgcagtggtttcgatcatggctcatcacagcctaaatcccctgggctcaatcgatcctcccacctcagcccccgaagtagctgggaccataggcacatgccaccacgcccagctaatgtttgtattttagtagagacagggtttacactatgttgcccaggcagtctgcctgcctcagactcccaaagtgctggtgttacaggcatgagcctccacgcctggccattatcattactattgaacaatgcataaagtcatctaaaatatattcttttgagggattaaataaccactattttaaaactctaatccttgggcaagttctctagtactagtctactcataggcaaattcagattcctttactgcactaacagaaattgtttgctaagctcattagtttatacccaatagtaaaactaagtcatagtatttatttcaagtttatttactgtgattattccacattatttggaagattgttattagatgtaataggaaatgtgtcttgagttttgtagttaacaagagccacggcgctactctagtcttacggtagatgtccaaagcagaggagggttccagtgaaaatcttaggccaaattcagaatgttttagacacaaaaaatgtcagacaagctggccatcaaaacttgccttaatgactgcccaaaataaaaagctgttaggcaggtaatcttacttattttgaaattgccaattaataaaataaaataataaaacacatcagaattgttaaaggatttcagaattttatgcactttccaataacacaactgcatatgtgtaattctcctattctcatgctaatactcaaatgtaggacataacttttccatatccacatgtgctatggagccacatgatctttgctatgctttgaatatagaagaaaacttgtgaacagtgggtttacctctaaaatgcccaatctaactactttccaaaagtaatacttgtttaatgtaacccacttggtcaccttcagcatccacttttaatagctagctcaaattttagtaatgtgcaggaaaaggtgtgtatatctatgcttttgagtatttccaggcatgtgtagatcctttaattaattaattaatttttaataatttcaacttttagatttagggatttgtagatcttctgaatcacttaagcctcacgtagccccagttttgggactggatatcctaacatcattatatatttttatggacaatatagaatagggaaaaacataaaatttcaaaatttcatatgactataaatattaaaatttcactctatgaaaaggaaaaaaaaagcaagggtttatttgctaaaatttaattatacaataaagatagcaaaatgaatggatgcttgttacctccaattcccaaatctttctctattattaagtaattcatagactttccttatgggaaaaggtcagggaaataaaatgttatgtagacttaatgaaaatttctatattcattttataggtaacttcctttaagtggaggcagagattaaaattaaaataagcagtgcaatcactctgacagcaagatgacctttcatgattcacttgccatttacaaaatgtacagcagaattactgagcactgaagattgtctcccagaaattcttctcaagggaaattaggacatttttattgccccatcagcatttattgctaagagaaacttctaattaaaaccgataacattatatcatacaactgctaaagtgtcactggataagcttgggttacatctaatataccataaatatagtatggaaacccatgaggaagaaaagagaagttttaaaactagcacatctactatgcgttttgttggcctgtaagtctttgattgttattaatagctacagtccgttctatagaaaaacatagctatacttaatttaattatgtccatctcaagccaagttaatttttcaacatatagtcagataagatctttatcaacattcctagtcaatggtgctgtcatatacaatgtttgctgtctctgtccatataaaactgatagaccaagactgctttatttccttctagagattaaagtttaataaagcaagtggccaccagatgaatagtatagcccaggcagtgttttgtgactgacagaaacatggttaactgagttaagtggactataacacacttttcaactcatttatctccataaaagtaaattattctctaaaaaaagagaaagcatcctattaaaataatttattacatttcaaaatatggtacttggatcaagacttaagaagagagaaatcaccagatgaaaattttgtatctcattcatgaaatcaaaacatatcatgttttttccttcaacttagatgtaacattttgttctaaattgctctttgtgaatttgtacagtgattcagaaaagtatttccaatggaaatagatttaatctggcccaaagttggagacttggaaagcgaatgtgtgaggaaacgcaaaggtgggaaagttggggccttgtcagagaacagtgatatgtatggtgatggaagtggcagaaatgacaggacagatacattgggttagaaatgtgtgaagggactatcagacttggaagttcaaattaaacttgatgatgaaaatggaaggagacaaaagttttgtcaacaaagagtgacatgaactcgagaaaagaacattcgcctgctcacactgtgtattatcactgggtgcatgcggaaaagaggttgagcatagaggccatttgtgagacacgtaaaacaccccaaaagtgtccttataactgtaggagagccaactatcacattgtaagggtcaaaagaacccagtttttctcagaatttgttcatctaagcaacaaagacacagaatgcattctcatacgatgccctgatactttgttttatcataaaatcatctctcaagagacagaccttcaagatttcctctctttttgcaccttttgacaagttaatccaaaaattgaaaggtggcaataaggaagagggaggaaaaagagtaacttgtgtatacacataaagattgtgcatgtataaagaaatgcctagaaattagagataggaatcagttgatagaaaaaagtaaaataattaaaacagccattctggtgttttgcaatatgctctcctcttctgtctattctacatgcaatcctaggaatactaaaggagataagttcctatgataataacataggctcccataaaagcttatgtgtatgttctggggagttggtttgatttttattaggagagaaatagttgagttcaccacagcctacatattaactgtatattaatatgtagttaaagagacttccgtacttaaatattgcaatggaagttctgtacaccactatatgaatttgaaaggatgagacagattgaaaatttcttcagttggaaaattcttccatttctccaaattgaaattcttcaattctgtgaatatttgtagagtgccaactatgtgccactgtcatacaagctgatgattcagaagtaaataaagcagggaacaatccctgccctcttggaacttactagtgagagaacagatgataatcagtagaaataagtttctctatatatgtttcgtgtgtgtgcatgatgttaaatttcaataagggttatggagaatatgaagtggaagagggagatagagtgtggtgaaacattatacattttaaataggatcgttggagaaggcctttctgaagagatgaaaagtaagtaaagatgggaagatgagggaatgagcatgtgactgtttgggaaaagtaattccaggcagaagtaatttcatatacaaaagttctgaggcagatgggtgccagtgtttatgttgtgtggcaaaaaggacagcgtggcttaaccagggacttttcagtggagaatctggaagataaattcacagagctgacggtcagtaaggtcaaatgatttacgccactgatggccgtgccagacttcgggtgtcagactgaatgaggtagcaaatttactggtgggagttgagtagagaaatgaaacagtctactcaagggttaagatccttcttgtgattgtgttgagaacagaaataacgatagacgatggagatacagatgcaagtagttatgtactctaatagtgggagttctttctgaccacttctatttttctccgtgaaatggaaagcaaattcatcacctgagcgaaaatgatgagacagtattacaggtttggagagtgaagtgatcaagagtcatctacgagagtcctaaaattacaggattatggatactgccagctaccgctaaggcccacttgaggttagaggtcatgaattttaggtgatatgtcagctagtgagcattttacttcagtcacttttagctgtatgggtgcagtgtggtgtggctaataatttgaatttaaccaggactggtattttgccaaattgctgtatgccaaattcaactatgatgaaaggagttggtggtgtgcacaagacagtgaaagacccaaggaatttctgctaaataaagaagggcacaaggacacaaagagggcaagacagcaaaaagggagaagggattgatggatttcatgtcttgagtcaaggattactgcagttgggctactagcaggagaagatggaaagctaaaatgtggtaacctgagagttggatgaaaaattctcatgtaaagactatgaaggcattgcagacttgacactgtaagagctgcagaatatgattttggagtcagtgactaaggtaggggggtgacaagatcattagaggagagaaggccaaaagtaacagagcccaggtattagaaacatcatctatgtcaatgctacttaaagtgttttccatggacctagccaatttgcaaactgtctattacaagcccgtgatagcaaaatacagaaattgggagaagtatttagaaaattttatagcaatgtaacagactaattttatgtctgtgaaatataatagtaaaaattttgagcttatgttttttcttttaaagtttattttattaaataatttttatttttctttacaccagtgtgggtatggcatcatttgcaaaacagtgaactatgtgaatgtaggagagagtgacaatgagccaggagttgaaatctttataggaatgagagggatgtgactgttaagaaggaggaatagcaggtggtgtggtttggtgtcatgagattaaaagatgggaatttcagaaaggaaaaaaaaaacagaatgagtaatgacgacacactcatatcaccctcagtattctaaagacttcagaggaagcagtgagctcagaggagagttagagcaagaaagtgaaggaagtgttgagcaagtgttgaagaatggagaattaccaagagattactaggttttaggctgtccaactttccgaagcccagccaatgggaggaatcacaatattatagaactgatactcatggaggtaaattatatcaactaaacatgttatatcagataccacaatgatgagataagctttatattttagttagttttcaactcaaatgtacctaatgtaaactaaacaacaactaaaagaggaagtcagtgaaagtgaaccctacatattattatgggtatttgtcaacatttctcatgtaaaaatacaaaatatatatatttatatcacataggttttcatttctaaattttatattactagagtttttccatcttttccattttaaaaattagtctataagtttagtatgttttcatgttgggaacttttctagtgaaaatcacatgaaaattcacttgtgaaaatgcagacttaatattaatccattggaatacacaatacacataaaatacagttaattacctgtaatctgtgccattgacaggtgtccatgtgtatgtcctgtttcctttgtcaatatatctctagaaagaagtttaacgtggttattatcactttacattttgtatgaatatatacgaaaagtaaagccgtagaatttacttataaattttgtagtcatttaatactcatctttacaaaggtatgatctattttattctatatttatttattttctgggtgtgtctagcaaaatttttgacagaaacaaatgtaagtgaaaaatctttatagtttatgccaaattattatcttcaaaacattgaaaacagtatttcctgaaaaacaaattttaataatgaaacaggactatgaagtatttagacaaggctcggatatgtccatactaaagtatgttaagagtaataggcaacatcaggacattaatgcagtgtgtctagatccaaatttatgattagcatatgactgtttttatgaagccactattatagcattattatggtatcataagaggctactcagtatcactgaaggttaggacaacatctaataaacccaccagggaaagaaaatacagagctaaggaagttcatgcatggctctatcttttatacattctgtcttccattaggtattgcgatggcacatgtataatttttttttttttttagacggagtatcgctctgtcacccaggctggagtgcagcggtgtgatctcggctcactgcaagctccgcctcccgggttcatgctattctcctgcttcagccttcccagtagctgggactacaggggcctgccaccacgcctggctcatttttttttttttttgtatttttagtagagacggggtttcactgtgttagccaggacggtctcgatctcctgacctcgtgatccacccgcctcggcctcccaaagtgctaggattacaggagtgagccaccgctctcagccgctggcacatgtataatttttaatttgcttagttatttttgagtttcatcattctcaccaaaacagtaacatgtattgaagtatttcttggtatcaggcactatgctaagcacctgtcattctgtcacttagtccaaccactggagtatatacttttatatcctgcaatttattgatgaagaaataagtgttaaagaagaggtaaggtgcttaagttggcaaaatatataatgccaaattcatgtttgtgacaactacacaatgaatgtgtgcgtgtttgtgtgtgagcatgtgtggggtgtatgtgtggcagatggaggggggaacagggttgtgaagagggctttggactagcaatattcttaaaagaattagaagaaacaatgcttatatatttgttactactcataaaaaaacagggcaagcaagtgttggtctgcaagttataaataaaatacagtatcagaaaacagtatcagagcagagaaataaaaatgtaagttttttcaatatcagtagcagaaattataatcttgttcagtcttcaatttgtaataaaataatcaaacggacaattttaaacattattactaattttttagtcaagaaatctatttttcaactgcttttgaagtttgaaagtattctcagattagcttcttaaaaaagtcattattcagtaagtttatccttactaaattctaccatctttcagtaaattttctgcatgaaatagtacaaatgaattctagttttagcccaagcatatagttataaacaaaggactgttgatggagtatgcataataaatacaaactattttcagattccaacaaaccagattcacttgggcataaattaagttgaaaagttctaattctattttaaacttatttcagtagtaatactaaaatccataaaaatgcagtatcataagggttagcatatgtgcattaaaaatttgattcatataatttctcatttattctatacacttacaatttttatagaatagtaagactcatgaaagacatgaccatgaaaaaaatgtttacaaattaatttcagacagattgtagtgaaaaatattcaataaatcaggtgtaaatagaggttctgtgggaaacatttcctaggtgaggaatttcaaattacttgcaactcattatgccaaacattgtgaaatgtgccaaactggagattcctagctcatcaatatggaacatggtacaagaaaggttctataattcctacaacaaccacaaaaatgaacttcaaagttaatagctaacctaagcctgtggaattcagctactttggctaaaccaaataacactataatgtgaaggttactatcacatcttaaatatctctgccaaaccccttacatagaccatatagatagagcttttgaaagatatcaccttaaaattagaataatacgtatgcacagtgttgtaattgtctataaaatagtgaatagtgataaaaattatagtcattcatagaataaataacttttcttgaaataccaatatacatagaaatctggagtacaaggcaatgtagtaattgaaaattagcagttatatctatttacaatagtgtgttcatcagagacattttaaaattctaagacaggaaaatatagtctttaggtgaatatttgtcaaaaaaagtaatttgcaataaattgaaggaagaaaaatatcaatgggagttaatagaatattactttgtaatctgagaaaagaatgtgcaaaagtctaagcaaatagagttgaagtttcaacaaagactgaaaggtaaatatacctccctttgcgttctgtaatagggactcattatgatattaaaatgagaaaggccatgtgctaatgaaggatcatagtcagatcctagctcaccttccacctagggaaggatctgatgaggaatttcagaggaatgtaattcatctagaaatgatgagattgtgaggaaaaggatataggttatacataaaagcttaagttaaaatttccaggctcaaaagcttctgagacttacatttttcaaatactcaaatgtataaatgtctgtatgtactccacatctgactaatagacataatcctctgactgataatagatatactccaatatgataatagacataaaccaattatttgtgggggtagttgtgttgtcacaggatttaatttcagatctaagtgctgggaaattttaaagtgtgtaactagtaaaagaagataaatcaagccagaaacaagtaaacaaaaagctaaaaataaaaataattaatatgtggaactcaataattagaataaaaaggcaaatcatgtaaaacatatagctattaaatattaacttcaattttgtaacattggcatagtgtaaaacaacatggcaacattatattgtgtattctatttctcataaaatatgtatgtaaaatataatttcaagaatatactgttaatgtataagaaaacatcaagaaacctaaagcaatagtattttataaaaagaaaaagagggttaaaaatatatcttagtgaaaatatccctccagctaagaagtgctttaaaaagaaaaattgtttcctagagatctccctgttttataagtaaatagtggattaatagaaaaaaaggacaagttaccaatatcaattattcttgatataatttttatttaagaataagctagaatcaattcttacctcatcttgagatttaaccagagttctgaatgttttttctccactttccccatcaatcatcttatttcgaatctaagagtaaatgaaacaactactttattccagaaacaaagctgacctgccaaaatatgactattaacatggtagtttttcaagttctttaccttatttagaacaaataaaataaaaatagggggttagttttaccagtatctgcagttgttctcagggaatttttttaagttaccatattatagtcattttacattattttaaaataataaaacacccttaatgaaatattttcaacctgttggtagtttttgaaacgtaattaataaaatgttcaattatattatggctagccacattggagtggaaagtagtcattgagacatagaaatgtatatgtacagaattacatataacacggaatgcttcaaatttctgccttacacaatgagtttcatgtgagaaaaatatttttaagaggactctttacactttttagtttgtaattcttatatctgggtaccaaaaaaatctaaataaaggacagagaaaactataaacacctatttggatttagaataatagagttgagtctccttcagtagaatactccaaatccttaaaaatatgcaaggtcggccaggtgcagtggctcatgcctgtaattccagcactttgggaggccgaggcggacaaattgcctgaggttgagagttcgagatcagcccagccagaatgatgaaaccccatttctactacaaatgcaaaaattagccaggcatggtggcaggcgcctgtaatcccagctacttgggaagctgaggcaggagaatggcatgaacccaggaggtggaggttgcagtgagctgagattgcgccactgcactccagcctgggcgacagagcgagactccacctcaaaaaaaaaaaaaaaaaaaagtgcaaggttacattatccactaaatattccagtcgactggcaattctcagaagtttcctcaacttattttttataactcaaccagtgatttacatgtggcttcgggaagctgcaaatgataagtaaacaaacttggtgtgattaaaggaataatttgaatttgaagaacacgaatgtttgatgtatctaatttagttcaaatatttgggtcttaaaggaaggagtagataacagcttctaatgtaagttgagtgtgcacttatgaggagctcaaaaataataaagactttaccatgaaccaggccttttgctaagtcctttctatatattatttcattcaatcactattactgattgatttagaagaaactgaggcttgcagaatctaagatcattttggtcactcactggagtaagagtccagacaccaagcttgtccccattactttatcctactttattatgtcaattactttacaacaaatactattaatcacctaaacaccctaacacaaggccaccgtctagggtaattataataaatcattaaattctattgttctacaattgaaatgcagtgacaagttataaaagaaacatgatggcatttgcaagggagttaatccatctggaaaaatcctaaaaatctgtaatctagaatgcaagagccaagttctgctacttattagctgaagaactgtagagaaactatttgacctctctgtacctcaaatgtatcatcagtacaacagatattataatttgaaataaaaatacctatttccaagcctcttgagaatccatgactaacatatatcatataatgttatttattatatatttctaatatttttattattaatataatactctcattattatggaagactctctcagaggaggaaatatgcaattttgcttttgaaataaaatagattgccaagtaaaatgtattaaggcaaacatgacagcttctactcatgctatttcttatgtgtttgggtggttggattccttccaacttttttttcaacactataacaacatcctccatctctatgatttttactgaagtttacaagatacatttgtattagaatagtgaaaatatgtctacctttaggaagagaaagaagactaaggtcgaacccaacttaaacatttattccttttcatatgatcttttggataggaaaacctaggatctagaaaattttaatgacaaagaacattcatctttgtgtatacagtatcaaacagacaagctaacacattgtagccgttcaacagatacttgtagaatgagtgcataccagcatctgacctgaggaattgtttagtcttactgattccactcacctccactttaatatcattctctaactctgcatcaaggaaatccaatgttactggctcctgagatttggggttctacacagaaaacaataataattaggtacatgtaacattatacaatgatgctgtgtataaaacaatttaacgggtatttatgaaattgtgcaaaaattacctaggatacaataattgtataaaggtatcttctttcatatatattttatatatatatatagcttatatataaaagctagagattgagctttaagtgcaggaaatcttaataagcaagtgaagacagtgtcattttgagtgctgtatttgatactgcatttatattcacaagctctttgggcacatcacttttgaagaaccattcacaactttcttttcattaattagcatgggaaaggggcaaaatatagccatttggatgacttatttggtaataaaacaatggcaacatgtaagcatacttttaaaatttgtaaaaaaaaaaaaaagtgtatgagaaaatgttttaaaattatgtctacacttgccaagtaaaacattctattggacctgttcttccttctgaaagtatataaagaaaaggtgcaagtttgcttcatatatttcaatctaagaaattttatattttaataattcaaatgacatcagaatgtataagataaattttgtggttgtcataaagattttaagattagctattataattaaagtcttactaggataataacccctgggttcaatgaatactatttcctattgcttcttcttgctggtgtataataataaagaaagaacactggggaataagatagattcttatttattcatatcattatataaaatgatactgttagtctggcaaatttacctcatatgatattattttaatgtctcaattgcaaaatgaagattcattgaactatttgataaacaaaatacagtcaattcctctataacttcctaagtaatgtaacatgtcatactaaaatttcaaagcttactagaccaataaaatcataataggtatatgtaatttcataattgcaaaattttagaaactgaatttttaatttttattaaaatattacctaaatctgataactagattccagtaacaaacgcaaactatgctggattagtgcaaaggtcactcaaactttaataatataagcctcacagactctttcaaaagatgttcaaattatcaccattttaagcactgttttaggaagaaacttcccaaggcagttgcaataagtaaaaatgtactaaaattaagcatatcttatcaagatgttgaatgacatagtatacacggcatgtatttactgacaaaaatgccttccttcaaagagtaattccacctaaagatgaaaatttttgattcctatggtttttgataaatgaacattcttaaaggcaaattttaaaaaatagccatgtctggcactttaattgaaaaaaatattcactgcttaagtactctatcactacaatcagaagattctagaatactgaaaataagtattaaatttttcaaaggtgaaaatgctgaccagtattggtaagatactgatgacatcttactgcgtgaaaaggaaatactcatttgaaatgcagcgtattttaaaagaataaaataaaagccaatgttgaaaattcttctaatttctttgtttaaaaaatgaaacctagaaaacccctaacaaaaggatactctaaagtttacaacattattcagaattgctcatttaatgtcccatgaaataaactgtcctcacacaaacaccatcatatcagcattaaaattttaacaaactcactgcaaagcaaagtcaaaataatgaaaataataaaaagtaaacagaaataagagtatttatcttacatgcaatggataatgcatagcatgaccagacccaaacagcatgcatggaggaggcattatcaggaagaattggcaatatgaagatcatgtcccaatccagcatacaaagacacagagaagaaaatgaaatcataaaagaaaaatctcaatgcataagttgtacttttaatatagcaatctagctgaccattttttaaaagattcaccacgggcatggtgactacaaaattcaaaagcataatctttcaataagaaagcaccaagagaggctgaagaactggaatatagtctctgcacacccattgtttttgtctgatattaaaatacctagtatttctcatttgcaaaatttggttatcaatggaaataaataccacaccatttgtggaaacgaaagaatgaaatgttaacaaattttaaattgaaataattactagatagtattacaaatgctacttagttcaaaaatagccttcaaattgaggagtcttgtgtggttgctagtttgccatttagagttttcttagaatgaaaacaaaaataaaacagaccattttcaggttgtttattttttaattatattgttaagagttacatgcaatatttgaggctgctgcaaaaacaaaaattcactaaaatgcacatgactgcaaaagtataagataatacataaaaagaaacatgcaaggacagtaacaaaacaatttactatatcaagaaaggcataaacataattttaaactttataggaattataaaagatatgaagactttcatatgcaacaataggaaattcagtttgttctaaaattctagcactggaagagagctaaagtttctcaactagggcagtggctctgcactttagacctccatggggagctttaaaaactatttagaggccgggcacagtggctcacacctgtaatcccagcactttgggaggccaaggcaggtggatcacgaggtcaggagatcaagaccatgctggccaacataatgaaaccccgtctctactaaaaatacaaaaattagatgggcatggtggccagcacctgtaatcccagctactcgggaggctgaggcaggagaatcatatgaacccaggagggagaggttgcagtaagccgagattgcgccactgcactccagcctagtgacagagtgagacccatctcagaaaaaaaataaataaataaacaaaacaaaacaaaaactatgtagaggcctggtcccatcactgccaaattaaatcagaattttcagaggatgaggcaggggactgacatatatatatttaatttcctaggtgaatatactgtgtaggatggaaactagtgactagttcaattctcctgcttttcagatgaagaaaattaaacactacaggatttagtggagtgctcaagaacacagtgttggctttcagaaccaaactagcactcaattctactaattcacagcttatccatctcttaataacatattacctcttcattttaatgtcaccaacttatttatttactcattttgtttttgagacggggtctcgctctgtcacccagcctggaggcagtggcacactcttggctcactgcaacctctgcctactgggtccaagcgattctgcctcagcttcttgagtggctgggactacaggcatgtactaccatgcctaactaatttttctttcttttttttttttttttttttttttttttttttttttttttgtagaggcagggtttcactatgttggcctggctggtctcaaactcctgaccttgtgatcggccctcctcagcctcccaaagtgttgggattataggcatgagccaccgtggccggccttaatgtcaccaactttttcaaagaaatggtaggcttacctacacaatcttaaataatgttgaacatgctttgaaattctgaaattctcttgctaagctataggaagtatccttttatgttgattattaatagttttactgtgcatttagaaatattgtatacatgtgataactgaagttttgttgccaaaaggaaaagctttcgcaatgagtttaccaggtaataaaaattcactacttatttgcactttggtacatttttaattagctaagggaaacttctttaacttctaacccaaaattacactttttagaaattttggcttaaaatctgtggcttatggaaactgtcatataggaattgtattttatttccacgtagaagtcaatttacaagcaaattgttaggatcacatgaatttgacattaattttacaattttaataacaaatttatttttagaagccatctcgttatgatttctctgattattaacttgattccataattgactttgcaatctttggttagccaatacacaccctctaccatcattaataacatttttgctccagcttattaagaaatgatgctcatctcatttcatgctctggaagcttgatgtcaggaaaggcagctttaattataagctttaagaacagaagcttaatcccaacttggatttagcaaatttgaaagcactgttaaggctaccttcattcacagttacctggatattgggtctcctttttcttaaattaattgttggtatacctacaccaataggctgaagcaacagaaaaatggtaattcatcatagtacatgtcaacataggtacgggttctatcctataatcaattttcgtcagatatttccttgattgcaaaaaggtctaaatgatagaattcaaaatatttggtaggtatggagttcatgagtcaataaaataagaatgtaaaaatatcttcaatgaatacaaactgttacatttttaagaaaaatgactattatttttctttttctagaaaagtacgtatttgggaagtgggaaaaatggttgtttgtcccagattacttttccattgatttgacaaaaaaaaaaaaaaaaaaaaaagagagagagagagagagaaataacaattttctcaaaaaattgacccaaatataaatatttttaatgtccatccctcaattcatatgttgaaatcctcatctccagagatgatggtatccaaaggcttttgggaggtgattaggtcttggttggtgggtccctcatgaatgggactggtgcccttgtaaaagacgccctagagagagacacgtctcaccccttctcctccatgtgaggttagagtgagaagatggctgtctagagggaggcaagcccttacagaacaccaatctgtccaagccttcatcttgaacttcccagtcttcagaactgtgagttactaaattctgtttataagccacccagtctatagtattttgttatagcagcctgaatgaaccaagaaaattgtacgatattaaaaagttttaacgtttcatatttgtgcctttgttttctgaagtgataccaaatgttatatctatgaaactaatagagaatgtaaccataacagtgtagatttattttaaatattaacttctcaaacatagattatgcacaatttcctatacaatacatatttcttagaattgaacaaaatgagatatctaattaagtagacctaacctggctacttcaatgacacaaaacggaagaaagttaaaatccattttggaataaagcagaatacataattcaacatacgtcaaaatgtggtcatgctggtaaaagtacacactgagaaaatgttatgaatccttaaaaaattaaatatgtgaaaagtccgtagctattttatgatattctgggggcttttaaagaacactcatcttctacaaaaaaaaaaagaggaatacttgcataacattagactttcaccttgttaaataataatggctgctatagatatagcattatttttcttcacttgtattaatgaatttctgataaaataattaagattttgttagtatactgttaccatatgttcctttgtatttgttgatttctaaagcaattatcttatactatatcatccttttatgaggtcttgtatcaatctgtatagcgtgctcctttagccactaaatggaatcataaatggaaatcataatatttactgaattaatgatgagaattcataagcatgaatttcagaaataaagaataaattgatgttcagaataatttctttttcatggtgttctgaaatagtatttttggaaatgtctttctgttacatattaatatttgctttaataaaatccaaatataaagatatgcaaagctaatttataatatggaagaaaaatatcaattgggctttaatgaagttgctaaagaatttgttttctctgtaatattataaattttagtgaattatttcaaatacgagccaaatataggttaatgtcattcaaatagtaatattttctacataaatactggttattagtagaagaatgtagaaaaggaaaaaaacttcaaattattacttctctttcactatgaaaactgcctaaattgttacagcccttagatggtagatttatatatatagatatatagatatatatatataaatcatatatgcattattgtacttattcttctgtctatgatatatgttagttcctttgggtaagggttaaggtttataatcacaaaagtagagatccttcacacccttcatcacattactttttttttttttttttgagatggagtttcgctcttgttgcccaggctggagtgcaatggcgtggtctcggctcactgcaacctccgcctcccgggttcaagagattctccctgactcagcctcccaaatagctgggattataggcatgtgccaccacacccggctaattttgtatttttagtagagacagggtttcaccatgttggccaggctggtctccaactcctgccctcaggtgatctgcccgcctgggcctcccaaagtgctgggattacaggcatgagccgccacgcccagcccacattacacttttattccttttgaattactttagttaggggaatttaattgaaaatacactggatatacaaagcccaaacaataatacttcaaaattataaaaaaatttaagatataaaaagttttcaagctatagcaaaatcataggatgattagccaaacataaattactcttttaagaggaatttaacaggatatgcttttaaagagctgtggtagtttaataataatatgaaaaagtacttatgcaacatttatattaaaacaacacatttaaacataactagggtgatcaacagctacacgtgctacagataattatgtgatgaatttgatatggaaatacgttccaaagtcagataaactaaaatagacattagttataaaatgtaatattatttaatgtattaaaatatataattaatatattacatttaatgtatttttgcattcaatatcaatagttctcttatggatttgaaccatatttaaataacacaagtttttgtgtgagtatgttcacacacttgtgatatattctaatatatgactaacattaactatccatgactcgggagaaagtagtagtatgcataagtctgcatggtttaaaggatcttcaacattatcttcaaagtataacaataactaaaaggatgcttctaaagttacaattataagacgtctaaataaattttgctattaatgccctgtgaaacagttcatgaagagtgaaatgagttgtacaaggtaatttgtgaaaatatcttgtatcttgagaaaataggcataaaaattaggataatatggttcatcgatggcattttatctctttcagattaacttgctgattaataaatacttcccatttctgaagcccatcacatggattttacttatacaatctcttacatctgtttacaggcctgtcctaaagtaaaaggaaaaccattctgggagatggaaagcagagttaattactagaagagaagggcaatagaaaatgtggcctggacataaataaacattactaatatttatcaggttcacactcctgtctggagcaatatcctttttatcttacagccttaaaatcaaagtcagaagtgggatgcatgaaattgaggctcagtgggtgataatggctgtctttgagataaaaatgttgcagctaaattggtaacagaaaatgaaaactgctttcacactttcatatagtatcatgtgtggtccttgtcatctaagaagagagacgcattagagactgtactttgatatttagtgttatacggtaaattttaaaacaacaatcctattaagaacattaatcattaattctacaaaacactaatcactgtaaacaaattatatactgacctttggctgaagatttggatgtaataaaacataaccattaggatcgattgcaaagtaatacccattggggcacagctggaaaagaaaaaaaaaaaaaagcttggatatgcctgagtcacaattagaaatctatattcttttaaatacataatgtattaaatacacattgtatagcatgttgaaagataacatggaatcattttattttagagatgcttttaaccatttagttcctttgctaagataactgcccataatttttgagaattacctaagtgccaagctaagttagtacagagttctaaactagaaagggtatcaaaagagcaaatttcatcttactgtaaaacgtggtgtcagtcttttaatatcttccaaagacacatctactcccatcacaccaagaatcagctggttctataataagagggcaaaaaatggcattttatgtcaaaaatttacgtatttttacacaattatcatatgatcatcttttgcttgcattatggttatattccacattagtttaaatgtatatatagggtgaagcactctcagtgtcaatttacaaggattctcagctttgtttcccacaactttatcatcatcatttaacttagcaaagaaaatctagataattgaggctaaaatatataaaggataaataaaaatgtttgacacttcttgtacccttttcttctaatatttattttcactgctattgtacggtcagcccttatagctgtgtgtctatatatgtgagtttagattgactttatggtttactataattaagaaaccacaagaatgtccagcttaaagattatacaatatagaataagaacacattggatttttgctgcagatagttcctgtgtatgtaactatcctaaaagtatgtgaccatattggtgataaaatcctcaaaacactatttctagtcactgctaataacttctatataccaagcaacaggcatcatagttttaggtgcaagtagaggaggcttgtggcaaactgctatcataatcttctatgggacataaagatggaaattgttttaaaattttgggtccaaaattgttgtttcaaatggaattatataaattataaaataataagcaaaaaattataaaatctagtaattacaaaaacatttaaaccttgtgtaggcacagatagagtaagaaagttgtatcaacaactatgctcttttccatgaaccaatcctagtctgagcaaaaacttcccaactgaagcaatctcttagttcacagtgagatctgtgaacacgtatgagaaagtgagagttactcttttatgagttacaatatttagaacctgcagatagttaagaatggtaataggcccccaaagagaaataactgttttctatggccaccttattaacataaggagttcaactgagatatataataactgatcaaacaatgcttaagtgcagcagacgtcatgaaaccataaactggaaataaatatctactcaaatcaagtatatcacctacattataaaatcagtttctagtattaaaaaagtcttaacttcaaaatctcaaattccttctgaatcaagctaaaaaattggaatgcaatcctatttaaaatcaaaagcatttaacaaataataagtacaagataaataatttttagaacttttaaataggcattttactgcattgacaaaaaaccagtgctataaaaattaagcattctatgaaattattcttcctgtatcctaaaaatagaaaaaaaaagagaaatattaatttaaatcagatccttaagttacaagataatttttaaaaagctattgtttgggagttggggaggaatgatttaatataccaatgtacacctgatacaaacatcgccatgcttttggtctttggatttttctttctaaactccattaatagctcagatggattcttaaaatgtgcacacaatattactgtccatttatcatataattactcccagagtctgactctgtgttctcatcaggtcatagttaagtggagttaagttgaatcttggctctagggcaacagagagtttgacctgcatttcctttttcccaggtggttatcgcataggcagctgttgcctttgacctctggcctcacaagacaattacactgcatgtattttcttatggaaatatcttatccatgttgagcttcaacgtcacagtttgtcatttattattattaattttatcaattaacttttaacctttaagtttgtcttattttcaaattggccggttatgttgaagaccggaagagttccagtaatgacaagtcccagttcctaaaaatagattcagagagaaagggcaaattaaaattacaatttaagctttgtcagagtgcactaacctttgatatctgagattgcattttatagttactttataaagagccacaaaaactagtaactcattttgaatatctattaaaatttatttttaaaatatcaaggaaaatatcttggaaataattaggacctactaggcacctactgaagcatgcaacatttaaaataatcctctaagataacttcaaaaataatcagcttacacaaatagtcaacagcctgtatgcatttcagtaaccctgtgtcctccccctttttcatagtgatagttcacctaatatcagggcctccataagcagagtgataataaaatattattttaagtgattatttagcttccctttttgtagccttattctttattttttatgccctaagccaaagacttcatgctaaatgaaaaatgtgcagttgaataacatgataaataaaagaaacattctattgatactgcatatctgggatattctaagtaaatgttacgctcttcagaagcagtactacttttctaagtagaccccaaaataagcagtactttttgacaagtaaaattatgaagaaaagacaactgcaagcatcaaatataaaagtctagtctgaagagtttaacatagtagaactaatgccatcctattaatcagcacataatttaatacattaaatgaatccatacagattagtcaaaataaactgattttcaagtcagagtttgcttttgttactgacatctatatccattataattttaaccatttcatgtcaaaactacatttaacaaaatcactctttaaaataatttttattgtttgaaattttgaatttgctaaatgagaaattattattaatcttctcacgaatagtgattccaaatccaaatctcaagaactcagaacagagttctggaatcagaaccgagttcataaagttggatttggaataattattcactagaacattaaaaatatttattaatatcagggagcaaatgttgtggtatcaggttgtggttcataattgtgcacataggaggcccaaattcaatgggaatatgaatgaattagggaggagagacaataatagagaagcttccagaagaccaaaataccaaattatttgcagcaaataaaactaaggaaacaaccatacatatttgggtgcatgatgattgatatggtttggctgtgttcccacacaaatctcatcttcagttgtagttcccataatccccacgtgttgtgggagagatccagaggtaattgaaccatggtacggtttcccccatgttattctcgtgatagtgagtaatttctcacgaggtctgatggtttttaagtggctttccccttcgctcaacacttattctctctcctgctgcctggcgaagagatgctttccgccatgattttaagtttcctgaggcctccccagccacatggaactgtgagtcaattaaaccttttttctttataaagtactcagtcttggggatttcttcacagcagtgtgagaacagactcatacagtgatagacacatgttggcgcttataaagtcctaaccaagaacattagacaatgaaacatccttaattatataaattaatgcttccaatgaaaacctcccacctcaataaagtcaggctatagattaattcgtaaaactggtatccaaaagataatttagtaaggatttggtgaagtgtctgttagagctataatctatatgcatggttttaaaaatgctaccatggtttaagacaaggtagatatggatgtaatcatttcctttgcattacttttgcatttatactgcataccataatttgcttctaaaaatggtaaaatgtagcctaaagtgagttactagattactaacatattaaagataattatgaatgaactcatttgggcccaacttgaatttttttctcatttactaagcagaccaaaaacttgtactctactcctgagtactgcacatgtctctagaaaataagagagaaataaaacaagatttctctaccctggaattttaaaaatattttctagagcccaactcttgtcatatctctttttataaagagcttcactttgtctcctaattaaaatgaactctccacaatattgtcctaatctccccttattaccaaaaatgaccaaggtatcatttttttgatatactcagtgcttccccaacttttatgctataccccatttttatggtttcacttttcaccaccaattgcaaaaatcttacactaatatcagctaaaatgtctccattttcttaaccacaacccactttgcccccaatattggcttcattttgaagtcagaattctttttctcattatatccattatatttcgttttgaaatatatttaccttttcctttttaatataactgtttatttttgaccaacatatatttttaatctgctgtgtggagagattataaacaaataactaggaatatatgaggatcactttatcatcttcaaaacagtaaaaataacgctatatgtgtccaatgaatagcaaattcacgtgttccttttttttttttttttacattcagtttcagcttatagcacagcacatttagaaccaacatttcctcctaatgtcatttgtgctatcagtaagaaccttaccagcaatgcagacatgctggctaatgaacttccagtcaaaggaaacacaacagggcataattattgactcctcctatcatacactgtcctgtgatggatttgaaaagtgcaacattttgaccacagctttggatcactatgtgaccttaagtaaatatgtgatgtctaaaaggaacactggacagtaattttaagctagggcttgaggtaagcaagcttcattttatcttccttagcgtgcaaggctgctgttaatagtgcctatttttcttctaacttcctgtatatgtttattttctaaaaaccaaatgataagtaattctaaatggactgcattttgccctatgggttcatcattacatttggaaaagtagtaagaacatatcactgaactccaagtagggaaaagggttactgaatcagcatttattttcaggtcttattattttgattctctccaaatatattattttagtaaattattcataagttcttctcattaagactaaacataagaataaagcttaagtgcgatgattattatttataactttcatgtcaggaaagtaaaaattacatttaaaagattttcaactttggccctattgacatttttggagggaaaatactttgttgtgtgtggtaggcattttcctctgcattacaggattgtttaacagcgtgcctggcctctgtccactcaggggtgtccaatcttttggcttctctgggccacactgagagaagatgaattgtcttgggccacacctaaaatacactaatactaacaatagttgagatttttaaaaaagcaaaaaataacataatgttttaagaaagtgtacaagtttatgttgggctgcattcaaagccatcctggaccacaggttggacaagcttgctctagatgccagtagcaacccctcccctcaagccatgacaatcaaaaatgcagattttttccaaatgaactgtgaggggcaaaaagacccccttgttgagaaccactgcttttaaatataatgacatatctttactaaaatgtcaattgtgcgatggacaatttaacatgtgtttgttatttcacaccagatttgatcgcctcaatgacgtatttccataaaaagtatgaggttgaatctagcacaaaagattatattaatacatgaagaagtttgtgatgatttcagtataaggtaaagtttttgcctatctaatcgcatgtactcctgagttttagcagatccagctatagctgtggaggctagacatgcttctactagctcctctactttaaaaatactttcttcaaaattattgttctaactctgcaaaaatagattctaattcacaaagactttcatctttttttttacattaacaattaaaaaacttattgaaatgcccatgtattcaacattccaggttggaaattctacattcccaatgaagggatcaagtagacaataagctaacactttgcatttgtagttttctactacatacgagtctatgtttttatgtaaattatataaattctaggaaagaagtctgtgatagaagaaattttggggagggtttaatgaaaaggaaaacagagacatcatctagaaagaagtagaaatcatctgtgtgcttttgttatgacagtctttgactgaatagctcaacctcttaccaatgcatccaggtacacatttgtccattggacttgcttagctttgtctcctgctaaaaccattggtcttcccaaaacatccaaatattcctgtttatgggaaaaaaaaaaaaagtcgtggttaaaactaggaatgctgtgttgaaataaaaattacagagaaaaaatattctagagttaaaaatgaatatagaatcaaaattattgacactgaatatataatcagttaatttctattttgggtactccataggtggtatggctacgttattttgaatgaacaatatttgacttacattatttatacaatatatctaccccagtttttttctagtaacaatcagagcattgtttttctgtgttacagccagtaagtgaaatacgttccctgtgaattgtttcatgttaatctaaactatttaaggctctgtgatttactgcgtggaattgcacaaatttaaaatcatacagcagccacatactttctttcatatcacagattgtttggctgaaattcaaaactacatttaaacacatcaaaaaataaaggaaatactgtgccaaatctagacatcagactcaaatgcagctgctgtttcatttcaacattcagtgtattcagtattcacgtccacaaatgccatgttatttatgctaaattttgacttcgtttattttgtagatcttcagctatgtttaaaaaggagtagcaattttcatagtaatttatgattatttaaaaagaataaatatttaaattaacttaattactacattctacaaaaagttatttaacaggcatgttttcaagtgaatgatgttagaaaaatcatctccttgttgtaactttattttagattgataaatagatccacaggggttatttgggaggtatttaagttccaactaggtccctgtaaaatttgtccagcataattagtgtttaattttatacacagtacctacaatttgaagaaacttttaaaaattatttgtagtagactcaagttcaaattacatgaaatgtatttttagaaaatttgattttatttattttctatgatgtttgtaacatctgaaaataacaatatactcattttattaacctgagttttggttatttgaaaacacttgcaatgttaatgaaataaaaccaatgtatcaacaagatactcagtattttaatataggtgtaatattatagatcttttcattcttgctaattttctccatattgagcatatttaaaccagaaaaatatcttttacttgaaaaaaataatttaaacaagttttaaataatcatacctgagtattgattcttattgcaccaatggaaggaatttcataataataacctgaaatatacatatatgtttttatacataaatgttactttataataaagggccacaaaattattttattttataaatattttataaagagtattttgaaaacaatatatttcacttcaaaactgagctaatactgaaatatcaaaattaaggatggttaatgaatcttcacaacaaacacacaggctttgtgaaaaatttcattacatttcttagttactataaaataggtattcttctatgaaggaataggaaacatggtatcattaaaaatattttttcattggataaattattaaagatgcatgatggataattattatatttatataaaatctttgcctaaatataactttcagaaaaaatttaagttctttttgttgccatggtatcacagttcatttctcaaattaacatatgtttttctcagtaacatcattctttctgagtgaaaatatgagctcactgcaaatatttgaattatcctggaatgtataaggtaatatttttcaaaaacagtaattaaaccactcagagaaaaaaatatgtatgtcatactctcatatttaagctttatgaaattcagatattgtttcattcctaatttttcatttaagattatatctgatatatatcattcagtataattcagtgtaatacattattttatgaatgtggaaatataatcagatatcagaattttcatataatgtaatgccagtgtcaaaattggtatgtgttttctctataaaaacatgttcagaatcttactcttgtctgattcctataaaagttagctacaattttagcttattttaaataagtacacctaataacaactaccaaaatagtttttcttctaatttattagaagaaaacagatttgttacctttgttttcacaggccatccactgaataggtcctctgtcataattgtgttgaccaactgaaaacgtgaatacacgtacctggatgaattgaaaaataggtattcattaggctgaataaaatttaattcaatggcaaaataaaacagctaaaatttctattgaaaagagtgctttccagttgaatgatatgacaagaaaaactgaggccagtaaagccttcagaaagagaccagaggaaaatcacataacctactgtaaacacagactccagttgctacatttaaatttgtacctgagtgtcatgttgcatattccaatcctcaggcaggagtatgactaatgtttcattcatagaaagtacatctttcatggccagacgcagtggctcacgctcgtaatcccagcacttcgggaggcccaggcgggcagatcacctgaggtcaggagttcgagaccatcctggctaacatggtgaaaccccgtttgtactaaaaatacaaaaaattagccgggccttatggtgggtgcctgtaatcccagctactcgggaagctgaggcagaattgcttgaaccagggaggcggaggttacagtgagctgaaattgtgccattgcactccagcttgggcaacaagagcgaaactccatttcaaaaaaagaaaaaagaaagaaagaaagaaaaaagaaaatacatctttgaggtccaacctcacttcacctgtctcacctggttatatatgttatctacatagctagtcactgcaaaaaaagcttatttccctatttcataggtatgtagtaatgaaaaagtattcagaaaggtcattgtacttcaaagttgcttaacacaattaaactttgtgatggttttcaccatggaaatatttgggatgcacacatataattatgttgttagtatattacttattttctataaaagttggctgacacatataaatagatattctaagctcctaggatttttaaatataatcaaaatattgactgttcctaacatgctataaagtatgcaaatattttaaaatcaatagagagtttttataatttatttattgaaagacattgaatttaaataatagtgtgaaagtataaaaggtaaattccatgaggtcaacctatacttaataaaattatttttacatatatattgatttttactaatttagtaatctaagtaaacccatactctcagctcaacattttagctatttctaaaaatagacatgcagaaaatcacttttccatgagttcaaattccagtttgaactatgttaagagcttttccctaattcatgttgactgactatttgaatggacattttctaattgttttgtatcttttaactgttgcacatgatttcagagtacaaatctcaaaagagatttcacatctgttctctgttctttcactggtcttggccacacagatcacattataacaatccctgcccccaaaacgtacatcagggatgttgctatttcatttgtaaggttttaggtgagccactcttacatcatccaggtttgccttagctggttacgtaagaggccacatggtgaacataatccaagctttaaatacttcaaactgtaagaataaataattgtttctaagtgaatgacagaagttggtttttttctctctctcaatctatctttctctccaggaattcccaatcaaaatgcaatggtttcattttctttaattcatcagttaggtcatttttgggtctgtctataaatttcaatgtagggttactgcttacagagttgagcttctaaatggaaatatttttataagcaggttgaccaccctaactgataattcaatttaaatgccataccctaaacaatcatcaaatgaattcaagtcagggaaaaagtccagatgctccaggaagcactgggggatctctctcataactaacatttgaacccatacctcaaattttcaacggaagcatggctttgcctagaagttcctgttaccacaacaatcatctagtaaaacatttttcataaaatacttttcagtaaaaaaataaacaagtaagactatatgaatcttatatctatgtctcagaaaggcaagcacttctaataacatcgaggctacactcagatccacacatatgattatttgactgatgttatcattcaaatagtccaaataaacactagccgcccgccccccccccccaaaaaaaaagcttgttgctttatttattttgctataaaagtttcacttaacttctacgtgtttgcttacatggacccctcagaggttgtcaaaattaaggtatttgggatcagggctggggtagtgcacattctgtcagctttaattataatttttgaaacacgccaaactcttttgtaaacctctttgttctttttcttgcataggttcttggctacttaaatgtaagctgcattaactaactgaatcattcccatgtcatcaatgtataatttgtaccccttttctcaattttcatttgccttgttgtagagatttttaaagacattattttcctgaaattttattccaagtgtttactaaaatcctaattgcaaatgcaaccttctttataatttatacaactgctttaccattacaatatttacgcaatctaatatacccaagattattttatcttggttttacgtatatgtatgtatatatacacacacatacaaacacatatgcacataggtatttaatgattttatggattatatagattatcttagagctttctataatgatcttataaatatatattcagttgagaagaagtttaatataagtcattcaaaacttaggatctattgtagtgccttacacacattctttgacagtaaaaaatcaatataaaaaaatttcattccctagcgccataccattgttgaacttgttttttctttgtacattttagctaattacataagaattttaacttcactgatttcataaactttcacattacatattgtatagtgcatataaataatgtattggttaaatttaaaagaacttttgtgtacacaactttccacttggaattgtaaatggtttcattcctcctattccatactatgctactgccaccatgtggaatagtcaatgaactaaattccagatgctaaagtccacagagatgattgataccctgcttcttcagatgttttttttttacttctttaaacttacagttcttgtttaaccttaattttggagttatagaaaaataaagtgattccttgaaatatgtacaatttaaaacttaaggtaaattaccttctcaaagatgtgtatttgtacagttcttttaagcacatttgcatgatcttacataaaaacaaaatgacatacaaaaataactcaaaatgcttaactagtagtcacacaagctaaatatttcatcttaactctcactcaagcaaatcacttacattagaggaggtctacatccaggctaaggcgacttttgtggagaaaaaattcctttactcatgcctagtagtatatttataatcacaacactaggttcatataacaaatgcacatgaaaacttttctgttgtgagtaaaatgttcctagaaaagtagctaattgtttctcaacatatatgattttatgtaggctcatctttcaaaatgtttgcttctatgaaattttcatcatagagtcacacaagacatatacagtaacagatggctttgacaaatatttttcataatgctggagtacaggtcttcaacagaaatactgtgggaagctagtattgaataaacgttggattgggctttaaaagttccaagattatacaatttagcttctattgtagtgtcttactcataaatgaaaacaaatgtttgttaaaaacaagtgaatagatgcttgagtggtttctacttcttaccagagggtaagaagactttggtgttatccaacatatcagtaagttcattacagtatgtggtaagagcaggaccaaaactgggctattagtgtcttgcattttgcaatttgggctgtttcactatacttacatcatcatacattcttaatctttttatttaatattaaataagcagacatccttactggaggtaaacaactttttaggcaaaatatacttagtacacttatttatgtactatattattccttgaaaataaaaaaaattcttataattctggattcacacatagttatataattgtaaaagcaatagtaatttggggagcagacttaataaaattgaacttaaatccaggtgtggtggctcatgcttataatcccagcactttgagaggctgaggtgggtggatcacttgagctcaggagttcaagaccagcctgggcaacatagtgagacccccatctctactaaaaatacaaaaattagctgagcatggtggctcacgcctgtaatcccagctaccctagggtgctgaggcaggagaatcgcttgaacccaggaggtggaggttgcagtgagcctagatcacaccactgcactctgtctgggcaacacagtgagtgagattctgtcttggtggggtgggggtggggtggatggggtaattaacttaaaaattaaattcgtggacaggtgcagtggctcatgtctgtaattccagcactttgggaggctgaggcaggtggatcatgaggtcaggagatcaagaccatcctggccaacatggtgaaaccccgtctgtactaaaaatacaaaaattagctgggcatggtggcacacacctgtaatcccaggtacttgggaagctgaggcaggagaattacttgaacccgggaggtggagattgcagtgaactgagatcacaccactgcacttcagcctggtgatggagtgagactccgtctcaaaacaaaaaacaaaaaacaaaaaaaattaaattcctatggctttttcatagttataaacttacataattttacttttagttgtttcaaaactatttttcttctgaaaggaacattataattccaataattaaatttggtattacagctctggcctacttgatttgagaagacttttaagtaagagcagttttggctatttacaatgtattactgatttgttccttatatcccactgatttgtaactttatcctacagttctgacttctgctaatctgtttttgttttgttttgtttgaaaactaaaatacttgtcttcaattaagagttttccaaagccacagggtcaacctattttaaaaagccataggaatttgtttcccagcagaacccagttactggaaactgtcacctcaacaattatcagttacccagagttcaactttaatttacaataggcaaatctccaaagaataatggaaattagtctatgaagaaagccaataaaaataaaataaaaacttcagccttcgaatcatgttagaaaaatgaagtcagaaataggttatattaatctactctgtgtactaaaatttttggcattaagcctatgaaaatactagattggatggaatattttagggtaaaattctaatgtggtttccataattcacaaatacatcagaatccagagcatttgactagcctatatctccagttttatagcattatgtaataaataaaagtgtccaaattcacctttcacactttattttataaagcccaaggatctgaaagttacttgcagcctgcaaagttttggtgatccaccttagcctatgaaagctgtaaggagcagatccctgtggggaagtcttgctgtctgacttgaaggcaggctcctgggtgggcaaattatgattagcatagccacagagctgctcagagaaagacacagacaaatggccagtcaggcgcattctgcatgaggttacggaattcagactgtagattaccatcttgactctgccacttagtagccacatgactttcagcaagttactttacttttctgattttgcttttcttatttccaaaatgggggtgatggtgatgatgatattattattatataatatgattattccagttgtaagtgaaaagtaaatataaggcattaatatatggaaattgtaagctctgtaagtattagctatggtaatgaagatgatgatgaagacaacaatgtcttttatagtcaaactattagtattaaatgatgtaatattttccattagtgggtctttagccttttatgcctcaagaggaacctaaaataactcaaaataacaccttcctagatgagcaaatttggtgagctttatcatacttagcaacaaactctaatgaaaaagggtattttctaaatgccattatgtccacataagatatatctatacgaaatttcctgtatttattgcaaatttacagatatgaccaacatatgtgctagagtgtctgacggagagaagaatttaatcgatgtctgttgaattcgctcaagtaaataaaacagaaaaactgttttataaacggcaacaaagtgcagtagtcatgtaagttttgcacacacattcacaaagaaccaagctagtgtttctcttgtgtgtcttacctgtgggtgtatgacatattttcatactatgatatttttaattcactagcaactataatgaatcatcctaataacatcagattataaggaagtaatctgaagtttcctttttctctatatgcatttagtactagataaaggaagaataagctacgggcccactgaatttccaagcaacttgcagttctgcaaagagtattatcagctgagaggtcagaatataagctgtatggtgatttatttcagatgtttctcttgggaaatgtcaaatacttcactgacactgataatgagaatgctcatgaaaaactatgtgttagactgattagagtgaagggaaaggtgccatcactacattttttatataaacggaagtgttccctacttataagatgacatatataagaacatctataacagttttattccacattccaaatttaggaaaataatgttgtttttaatgatttccttctaaaagaacaaagctatttaatttttctaacatttatgaattttgtatagattaggagcatatttattgcctatgtactgatatgaccaacatatctgctagtaatgagcacctaccatgcatcaagtactgtgccatcctttaagaattaattcattggtatgtttacaaatgtatacaactacttcgtggagtttatattagagaggaaggctccagataaaaagcaaagaaagcattaaaataattaaaaaatggtaatctgagggaaagaagaccaggaagaaagagggtgctgaaatagagaatgataaaggggatgtctggggaaagagacaactgtagaaaggttgactgggggaaaatccctctgataagatatactgtgagcagagttcttaatcagagaagagagcagcagaaaaaccagcaaaaagtgcctttctggcataacattttaacacaaacaatgggcaatctcaattctaggtagtaaattttacttggaatttcaagtgccatttctgtgctataaagtttacatcatatcatatactctgtgcataaagtaatacttaacctcatttttcattcagtttgttttagatattaaaaggactttgtaaaatgcattaaagtcatattattcaaagctgaagatgtgcctggtaaaatattccttagtttgagggactgacaacactaattttactctatgagaaacaagtgtaaataaatgttatcagagacaagaacacacacacacacacacacacacacacacgtgcataaaacttatcttttaaattgatgatcgctctactagctgggcatattacattgtagttattgttttcagcttcacagtaactccagaataaatacttggtttttatgaacaaaggtagagccctattctaaagctaaaaatttaagaagctgttgaaagcatcaaaatatctgaaacaaaagtttttagaagcaatccatgtgttaaatagaattaaatgctacaagttaaatgtctttcattatcatatatttgaacatttcctccaaaggctttacttttgcatgaagaagccaagcagagacattagatatgcaataaattattttccatggattattttccttactatctgttgaaaaactgacaatgttcactctaactacataaaacacatctgcatattcagatatttgtaacttggtttagattttacaaactattgaccatttctagtttggatctgagagcaaaatagaaaagactttctcaatcattttttaaagtgaattctttaaaataagtacgttaagaataatgcattctcaaaaatggatttattgtcaagtgattataactttagatgtgcattctttattttgaaagttatttcatatcatatgcttttttctcatttgttctcattcaatttactagttattttgaaatttttattaatttgaatgttttttcattttttaaattaattctgagaattaaagaatcagagaactatttccttactggctaggcaatcttaagtatgtattgctaagcagtcccttggctattctatggaaaataaaataattttgctagccctggaaattatctttcaactctgtgtctggttttactttcctttattcatttgtttggactacgggatagagttcattttagttttggcactatttttaaggaggtctcatgtacatgggtgagccctaaggaatggcaatgctgcaggtaaagattataaagcaaatgtattttaatttggaacagctgtgtgaggagattaacatggatcctgttttaaagctatacctatctataatcaggtagattaattcccaagagtagcacatttcacaaaagaactcaaacattttgttctaattctcaaaccttttggcctcattaaattgtgctgtgtatctcctgcagcctcattcatcagctctccaattgtaactcatcaggcctacctggattgctctgaaagatttctgattcatctagatgaaatatgaatgtaaatgaagcattctgcagccacattagtattaaacaagaggcttgggggaaaacaaagagttaggtttttttttttaagctcaccaaactttctttcaagatgttgtaatttttctgtatttctaaattttattacattatggtaagaactaccatcctatggtgagatctaccatcctaacacacatttaaatgtacaatgtattacggctgattctaagtacaatgtttacagcagatctctggagcttattcatcttgcttaactgaaactttatgtccactgattagtaactccccatttctcccttctccccacttcaggcaaccactatttcactcttcgaatctatgaaattgaccatttttgatatctcatgtaagtggaatcatgcaatattttttgattggtttatttcacttggtacaatgtcttcaaggttcatccaggtttgcacatattgagaatttccttttatttatgctgagtagcattgcattgtatgtatataccacattttctttatctattcatctgtcaaggaacattaaggttgtttccacatctaggctattttgaatagtgctgtaatgaatatagaagtactcttcaagatcctaacttcagttttttttttggataagtatccagaagtaggctttctggatgctatggtagttatatttttaattctttgagggacctccatattattttccgtgggtgctgcacaattttgccttctcatcaacattgtgcaaggattccaccttctccacatcctccccaacacttgtcttttgtttctttgatgacagcaatcctgacaggtaagagatgatatctcattttggttttgatttatatttccctgatgaccagtaatgtacattttttcatgtagctattggctacctctatgtcttttctccaaaaacatcaagtacttagctcatttttcaattgggttattagagatgttttgctcttgagttgtaggagttattttcatattttgtatactaaccccttatcaaatatatggcttgtaaatattttcccaattccaaaagttgtctttatagctctgttgattgtttccttttctgtggacaagagttttagcttgatgtagtctcacttatttttggatttattacctatgtttttagtgctgtatccatgaaatcattaccaaaataaatgaatgccatgaagctttctccctgttctctttcaggagttttaacattttaggtcttaaattttagattttaatccattttgagttgttctttgtgtatggtgtcagataaggatccaatttcatctttatttgcatgtcaatattcagttttccaacaccatttgttgcacaatggggaaaccattatgtattgtttgcacccttatagaggatcaattggccatatatccatggagttatttctgggatctctattctgttccaaaggtctaaatgtctgtctttatgctagtgccctactgttttgattaccagaagctttgtaatacattttgatattaggaggtgtgatgcctccagctttagtcttgttttgttcaagatttctttggctattttgtggtcttttgtagttttatatgtattttagaatttttttctatttttattaaaaatgccattgggattttgatggaggttgcagtgaaactgtagatcactttgggtactatggaaattttaacaatattaagtcttccaatccattaacatgagatgtctttccattggtgtcttctttaatttctttcatcacagtgttacagttttcagtatataaaactcctttgttaagttcgcctcctttgttaagtttattcctaactgtagtattctttttgggtctattgtaaatgagattgttttcctcattttcctttcaggtagttagttgttagagtatagaaacacaactgatttttcaaatgttgatgttgtctcctgcaatgttactgaattttgtttatttgttctaatgagctttttgaagtcctttagtgtcttctatatttagatcatgtcatctgcaaaaggagactatttatttctgctactaatttctagtttcactccactgtggtcagtaaggagactgggtatgatttcaatctgaatttgttaagaatttgttgtgacctaacgtatgatctatcctgaagaatgttccatatgcacttgagaaaaatgtgtattatttctattgggtcaaatgttctctatctgtttaagtctatttggttatagtgttgttcaagtcctctgtttccagattgatcatctgtctggctgttctatccatcactgaaagtgaggtattcaagctttctagtattattgtattgctgcctatttgccccttcagtgctgtccatgtttgctttatatatttagatgttctgatgttgggtgcatacatctttgttatatattattgctggattgatgcttttattatataacatccttctttgtctcgtgtcagttttttttttttttttacttaaagcctgttttgtctgatataaatgtagctatccatactttcttttggttatcatttgcatggaataacttttttcatcccttcacttttagcctatgtgtgtccttaaatctaaagtgaacttctgataggcagcatatagtgtggttttgttttttatccattcagccactctgtgtcttttgactggggagtttaattcatttacatttaaaattattattgataagacaaaatttattaatgtcattttgttattttctgtcttatttttcttttgtattttctttcttcctttatgtttgtcattttgatattttaaagttacatgtgaacttatttaaaaaaagtttttttaaaaagttgcattcaaacatagaatttttaagagtactgagcatttatattttactaaatctatcgaatttcatttttacacattggccatttgaaagatagtatttctgtggaaagtgaaatgctgagttgataaacgtattatgtaacattaattttgtggctctggaattagtactgcatgcacaactttagataacaataaacaattatctttgttattaatatctgtgggctgcagatcgctcacacagggtgggtgtgtgtacagcaggcaataaagttagaacatgttcctcaattcatccacacacatttgaagccatatttgaagatggtgaaaaatatataatgtacatatgtacactattttatgtatataagcactctacacatacacatatgtcctgggcataaacaattactacacaaatgctgttgttttaataaaatacaggtatactcaaaagtataactgaattaaaggtggttgtctgctatcatttatactcattattagtggacacagaacatgcaaatacttgttttcatttatttgtgggatctaaagatcaaagtaattgaacttcaggagatagagaagagaatagtggttatcagaggctgagaagggtatgctgggggtttgtagggaggtggagatgattaatgggtacaaaaaaatagaatgaaaaagacctagttcttgacagcacaagagggatatagtaaataataatggtacatttaaaaataatgaaaatgtataattgggttctttgtaatgcaaaggataaatgcttaaggggatgggtactcaattttccatgatgtaatgtgattgcatgcctgtacctaaatatctcaaattccaagatgaacgttttattcatttaacatggccttctcacattagaaaatgtgggatgtcatttaacttcacagtgcatatgaaatgtgggacagcaatgtttccagaaattaatacctacttgtcaaattcagaaacgtgttccatctctctctcaatccctcctcttttcaagatctctatcaattagcctttctcagttttgtatctataagctttccttgtctgagtatcctttcattcatctttagcctataataatgtataaggtcttctattgtaaaataatatgcatataatcatatgtgtgtacaggtatatctcattttatcatggttctttgttgcattttttacagattggaggtttgtggcaaccctgtatcaagtaagtccactgttgccatttttccaacagcacacgctaacttcatgtctctgtcacagtttagtaattcttagaatagtttaatctttttcattattattacatctgttatagtgatcattatatctgatacagtgaatatagtgatatcatactgttatattcagtggtccctgaagctggcagaggttggctcatgaggtgtaaggaaaaaaggcatctctataacataaaagtgcaaggtgaagcagcaagtgctgatgtagaagctgcagcaagttatccagaagatgtagctaagatcactggtgaaggccactataataaacaacagattttcaatgtagagaaaacagccttgtatttgaagacaattttatctaggactttcatagctaaaaaggagaagttattgcctgcttcaaagcttcaaaggacaggctgactttcttcttagtagctaatgcacttggtgactttaagtggaagccagtgctcttttaccattccaaaaatctcagggtccttaagaattatgctaaatctactctgcttatgctctgcaaatgaaccaacaaagcctggatgacagcacatctgtttacagcatggtttactgaatattttgagcccactattgaaacatatgttaaaaaaaaattattgctcactgacaatgtaggtagtcgcccaagagctctgatggagatttacaaggagattaatgtgttttcatgcctgctaacacaacttgcattttgtagcacatggatcaagaactaattgtgactttcaagtcttattaattatttaagaaacacatttggtaagactatagctgctataaattgtgattcctcttactgatctgggaaaacccaactgaaaaccttctagaaagatccacaattctatataccattacaaacattcgtgattcatgggaaaagacaaaaatatcgacattatcgggaatttggaagaagttgatttcaacccttgtggatggctttgaggggttctagcattcagtggaggatgtaacagcagatgtggatgtggtggaaacagcaagagaactagaagtggacactgaagatgggctgaattgctacaatctcatgataaaacttgaacaaatgaggagttgcttcttacggatgagcaaagaaagtggtttcttgagatggaatctactcctggtaaagatgttgtgaacattcttcaagtgacccaaaggatatagaatattagatgaacttatttgataaagcagtgccagggtttgagagaaatgactccaagttttaaaagttctgtgtgggtaaaatgctatcaaatagcactgcatactacagagaaatcttttgtgaaaggaagagtcagtcaatgcagccagcttcattgttgtcctattttaagaaattgccatagccatccaaccctcagcaaccaccactttaatcagtcagcagccatcaacattaaggcaagaccctccaccagcaaaaatacaaagacttgctgaagtcttagatgatcgttagtgtttgttatacattttgtgaattaaagaatagagtattctttaattaaggtatgtactttttttagacaaagtgctatcacacaattaagagactacagtatatagtaaacataacttttatacacaatgggaaaacaaaaaacttgtgtgactcacttaattgcaattttcactctattgtggttgtggtgatctggaaccaaaccctcagcatctttgaggtatgcctgtgtgtgtgcgcacaacttgaccctgagttaactgtcttattcttctcttttatttcttagcaaatttgccatgatttaaaaaagaaaaacagcttatatttatattcctacttcctcattcctcatttacttctcaaccatctgttggcttttgctcatatcactttatgtaagagaggtcatgccaaagctatatacatggttccttgttcctggaggggatatccatttgaaacagatataaatatgtgtggatatatatatatgtatgtatgtatgtatgtatgcaggcttttatatatgtattactgtgtatcacagaactttgttatagcctctgaagttagaaaaacaaacaatataatatgcagttccaagaatattttaatttttatgttagagacaaaattaaatgaaacatcaccacaactgaatgttaactacttaattttcacaattgccttggcattaataaaggttatatgttttcaggaaaaatgtgtgtgtccttaaaacacagcatcagtatgttagcagacaaagagcaggactgttgaagttgaatataacttgatttattagttttataaaagtacatgtgatatgaatctttttatcatgtggtttatcttgtcatgaaatgcaacctttgtttaaaaagttgagctcctgtaaaaggtgactggaatgagaagctgtatttcaagataatgatatttagattggacatttttaggatccatacatagaaaagaagctttaaacccataaattcttcactaattcaaccaactgaacaatttgtgaaaatagtggatggaatacatttactttccttataacataaaactttgtgtgtttaaaaaaaagaaaaagatcaaattaatgatatgcctccaagacactatgtgttaatcctggatgtatagagaattccgaaacaggaaaaaaaaaaacaaaaaacaccacatttctgaatttacatgaaagcaacttgttcttatttatatacttttagttaaatccacctgaaaaaacctttatactcttttaaaatcggatatatctcatgcacaaatttgaacacagaatgtaaaattcattgccatctttgagtcaaaaacttttcatttttgaaataaagtatgtagaggtgaacaagattcctagtggttgctttggatgattacataatgaaaggaaaaaaatgatttatttacacttagtacctattaaaatgatataagtagtggcttgcacttatatacttctatcacaaaatagtatacttaaaattatgacaaatataagatgctaaaaagtcccttccaattatcagagtaagattaatttgtaaatttttgagatagtacattttatattaatagaattgaattttgtgttaaacttttgttatatttgagttcttcaaaataaggaaatgctagattatttaaaatatgtgaaagcagcatattccttgcccccagttatattttataattataaatctgtcctgtaacagcactcatgcttccaacctctgttacgtattctcaatttatttgttgtgatgtattaggaactatcactggatctgtgctctgggctgcatgcctaaagttcacagttaaacaggacactgtcccaatactgtagattttttttttttaatccagagaggaacagaggagagatgccatgggtagagtacagagtgaaggatatgtatatggctttgcacagtgtgctatgggatcagaggccaagcatctaaaggagcctacagtggcaaggaggttcagggacatcttccaggtggtgaggattaccctgaattttgattaaggagtaagagttattaaataaagatatgcacatattagttaatgcatctggatattcccattcatttctgatgatttctttgaaagaaatattcgtagaatctagttatcacttgaaaatattcacaatctattaacagctcagttcatttatcaacttttcaaaagtggttcctctatgctattaaaatcaccagatgctaaacaaaaaccaaaagatgtacccttaaaccttacattaaactgtatgacactgtagtacatgcagtaagcagagtttaattaatttgaaattatatgtgtattatttcagtcttttgatcattttcaaatactcataggccgaaaattttagcacctagagtatcttaaagggttccaaaaattttcatcaaactgttcgccattattcacaatattttgtcaccaaaccatctgaacatattcatttttgtctcgcttttcaacacccaatccatgtgtgttcctcaagcacatataaaacaatccattagagctagcaataaccacacctttcaaaatggtgaaaattccaatcagaagcaaagtgaatgggcattttaccctgcagagtcttcttatatataaatgtatgatttttgtagaaatttttgaaacaccagaaagagtttataatttctcattactttttaaatgaatcattagcattttaggaaaccaggttgagaatcacagtattcttacaaaatgtggagtgttggtcagaaaattgaaataagctgataataggacggctagaaaaagtagttagagttttgattgaagctgatattcctccacagtatcaggttcaatgaggtccctctctgtaatactcttcccttatagtaaaacatacattcaaatatattccaactacaaacactaatcttcacagtcttcatttgcttatgaaatgctttcttttaatacattatacctataaaaggatttgtcttcatcttttcttgaaaggaatcagttttcaaatgaggatgtagtttttgctgttgtaaactgcctttttgtaaatttacaaaacaatacttagacattttttgagtatttaggaaatttgagtattactgcaatctttaataattaaataatataataaattttatccaataaaccttaaagtttaaaatttttcctattttaccattcctttgatttctctattttaataacattttatttacaatctatgcataagaataaaataggacccatacatatactttattaacatattaggcatgagttgcttgtgaatatgatataaatattatacttaacagctctctaatacacctattagtttataatctatgattcatatggctttataattggcacaatcaggttttaaatcaaaaattctcccctcactaccactacccactatctctttaaaaaccacctagatcattattaaaatttaaatattataaaattacactcacttttttatctttattgtatttgttaaatatctcctgggctctctcttctcctccatccgtgaatagcataataatcttattgcagtttgctctggaaacattatactgttaaaaacaaaaccaaacaaaacaatatgcgtattattcacaataaaagagaaaataaagctatatggaacgagcatgagcaggttgcaagtaattaatgaaatatctgctcacaaaatatattctaagaactggttcctggatcagttcaggcccacccccttcaccaggccttcccctcaccacccagataaccataagtctatctcacttccttcagtctttgatcatacgccactttatcatgaggtgattactcacaactatgttttaaattgcagtctccctccaagatagtatgtttcttcatagcattttactttcttttatatacatattttattttcttgtttgtttattgttggtatcccccaacagaatgtaagctacataagggaaggaagctttgtcttttttgctcaaagacttctttgtccctccatagaagactgcctagcacataataaaatctcagtagtttattaaaaaaatgagcttttaataaatgtcaattttatgcacatatgattttatagtataaacaaaaaataacattaatttaaaatgtgtatcttcaatccactttcaaataagtgttttcttccctctttattcattctactttattcacttcacatgtttgaaatcacaaatcctaacactggtcacctaaaatgcaatgctcttttgttcctttgtaaatgctgatacctattcccaggatgtcctcttatcctctctcaaccaaccacacatattctaatcctgaaagactcaagtccatggtaaatcttcttacactttaaggtctccaaaagagttagatatgggagaatgatggattagcaccaaagggccattaaaatgaacaattaatttagaaagctggacttctccgaggtccaaaattattatcttaacttttctactgttgtgaaatgtgtttgctttaaatgctgagaataaaagatcacactaatttatgaatgctcagcttctttgaaaatgtcaaccctaggttcagtgctgtccaaaagaaatataacatgagcctcatatggaactttaaattttctaataactactttaaggggagtaataagaaatatctgacattaatcctaataatatattttctttaacccagtcatccaaaatattaatcaatattaggtatcaatcaatattgagatgttatacagctttttcttccataagtcttcaaacttcagtatgcattttatacttacacaacatatcatttcagatcagccacctttcaagtgctcactagccacctgtgattgttgttaccatattgtacagcatggcacagccctggcttttaaatgactaatattttttaaaaattattttttctttagtgttctaagtcattgaaggtccatgctctaccttattttttcaaagaagataaaacccattttcccttgtgaaaattaataaatacaacgtttttctttattaatgaaaagatcctgtttcaggtcatctcattccatggactcagccattagaacattggcagtaaaagcttttaatcaaacattgtgaaagcacaagtattaactaatataatttgtcactttcaacatggctgttatctttgaaggtaacctatctgaaaatctgactacacaaaaagttgcctattttatcatcaaaatagttttgtgaaacatgcctcaaatcccttaactaaaattagtttctctagtgatttgtcttttttatctgcatgtgtaaaatagtcaaaataatatgtacctaaagaactatcctgtaaaaatgttaaacaaaaccataggacatggttttgtttttgaagtactgaaagtactattattggatgcaaatatcaatgtaaatcaacacattaggtcttgctgatcatttgtatacttacgtaaataaaattataacaacatttcccgagagagagatgttagggcatacacaaaagaaggaatatggggaaaataaagaaattgttttgccttcaacatgatttttcctaggagtagcctctcaggacttgtggtggagccaagtacataatagcaaattttccatgcatttgcaattatctaaagaatcacacagcgacaacaattaactggctttgaacaaattaagccaaaaaaacaagattgtttcaataaaattacaattagtagagttggtaacttactttaatatggtagtttgctgtatttctgtgtgccagtatatagcacagcatctatcatatatacactctatataaagtttttttgaaaaatgcatatatatggtaatattttatgaaatggtacctgaagattaattcaaatctaaatgtaagttttactttgggactgatatgtctaatgctatttaatacttgcttcagtgatcttaaaggtaaatgctgcgaggacaaaaaaaaaaccagaatggcatttgagcaataagatgactggaagtgtttgaaagaaaacacaatatgcttcaaattattttaacataaagaatttcaatatatatgtgggatgtatggaaagtaaaacacattagacttacttagggaacaactgggaccatattttaaaaatcactacaattgtagcagttataaaggcagcaggagaggccaataggagttaaatcatattttatcagcaactagtaataaatctggaagttaatgtggcctctctagtgaggctacctctgaaattgtactttacacttgaaactcctgatcatttcacaactgaaacctaaacaggaggcaatgaagtgaggggaaaaaaaatactaagaagaataattaaaatgccaagatcaaggaaactcaattattgacttaagcaaaaaataatttttatcaaaaacaaccatattcctttactagaggaaggatacatcttaatctaacggttaattacagtacaattttgtagttttgagcttttaatttttattaatgaacatacaacatttaacaaacatatgcatctcaccacacattatttcccttggaaatagcagggctgcacatctctgattttctgtcttcttaatctaacggtgtctattaaataacatgacctcaaattcaacatatctgaaactgagctatttctacccccacatttcctctatgtgtgttcctgtgcaatcatctacttactagttcagttcagagaatgtagagtcacctaagcccctctcactctgcaacccagcccacaccacttaatcagttcccatgccatgctccttaatagctcctcacttctattcccacaccagcatctctacgaataccttccttaacttagaacactccaaggccatactataaagttttcctttgcccctaaacacttccttaactgatacctcatggcctttccatttccatcaagttcctatattgctcatgtcccaactatgccagccatctgcaattttttactgtgctatgttgtgtcacacttctgtgatttgtctaaaatatgctcctttttctgaaataattttcccttcctctacctacctaagttctaatcattcttcaaaacctcattttcacggaaatgccacacttttcctgacctcctttgaggagctgggcccatcctctgtgctgtcccagggaacacgctaaatatcctgtaatggcacttgcacactgttctgtggatgatgatttagcactcagagcagctggtcctgtttacttctataattccagcaccagcactatgacaggaaatggtgatgcattcaataaattttggctgaatgaataaatgaatcacccaattggatatctcaaaaactatttagaatattcactcaggaacaacaaactcatatttgcataaagatcaaatataagagttcattcagtgattcagcaaatattaacagacattatgatctgactttttaccagatgtgggctagtaattacagcaataatgaccatgactccaataccacccagcaacctacacctgcgtgtggtttgctacatgccaggttccgtggacaatcttatgcacaattctctgaggtacatgtcatagtgacctctaatgcatacaagtggaaaccaaggtgcagagaagtaaggttcctactctcaaacatgataataatattgcctagtaagaaataaaataattgaacaatggtccctgcttttaagtaactcaaagtgaaatagagggcaaggcaatttaaaaacactagtccacagtatgagacacacactataaggctggaagcggtagctcatgcctgtaatcccagcacattgggaggccaaggcgggtggatcacctggggtcagaagttcaacaccagcttggccaacatggtgaaaccccgtctctactaaaaatacaaaaattagctgggcatggtggcgggtgcctgtaatcccagctacttgggaggctgaggcaggaaaatcgcttgcacccaggaagcggaggttgcaacgagccaagatcgtgccactgcactccagcctaggtgacaagagtgaaactccatttcaaaaaaaaaaaagacacatgctataacatggggcaataagcacgccagtatctgacagtctagacactgatgagtgattgtggggaatcctcactcagaaagaattcctgctccgggagttgcatttctgttcatcttaatgtctaccatttggaactttctgtacattttaggaacaatttaaagacccaaactagatgtttaaaactaaaatgttctcagtaaccatttgatgattgaaagtgcaaggttacagataaatactgtggtgattgagataagaaaaagtaatgatattctatataggccaattaagtttcaagtgcttattcaaaattaaattatttccttataaatttttttaaaacatagataaaaaatatcaaaaacttaaaaatctacattttagatgccttttgaattttaaattcaaagataaaaatagttcaaaggtttcttctgcctgcacacatctgtgttttaaataaatgaaaaacagcactatctaatcccagagagtagtaactatcagaatattgaaattcagatactacaattgaacaacaacaacaacaaaagacatagcatgatacttacattaagcagctgttcaaaagcaaaactaaagcccttcttataatctgtaattcctttggctgtgatattattcaccgcgtctttcaacacttttttatttcttacatttgcttggacaaggtgctgaaaacagcttacatcctgagcattgctgttaaactgcaaaagattaaaaagtaaatatataaatgaacattaaaatcaaccatatagttttcatagaatttgtgtttgatactcctaaacggtattgcattgcttactctttcaaatggaaaagtgagtaggctggtgacaaaggtgcattaagaaaccaatggctattttcatctgagctaccaacccatactggaacgctgagtctgctgcttatattcccgaagcctgctttccctgcttataaatttgagaattaaattatatgacatcccttctagttctcaaatttaatgagcatgtagaaaaaataatccaaagcaatgaaatagatgcaggatccagaaatgatatgggatgcttgccctggttgtgtggacatgttaaatattttcattgcctcttattaggaaagactggttggaaaagtaatacactgaataacatgaatcaatgtttagtcattttgaaatctgatggtactgtctttctacagaggctaacagaggaaagcaatctgaatcaagaacaactggtagccttttagaaatatcactttagaggttactaaagagtgccaggggaaccttggaggcaaggtgatggagccctgaacagcagagaggctgtgggagagaaaacatcaactccaacgataactgcccaaaatggaaaatttaagaacgatcatcaaagtaacttcgtcaaccccataaaaaatattcacatcgttccctggatatttccaaaaagaaagaacaataggaatgctgcaacaaaatccaggataagaggatgagtggagtcatccaatcatttattaactctgtaatttgtgaaagttattcaggctcttggcacctaaactgtcacatctgcagaatgggaataataaaaaaaagcatatttgccagaaaaaagggactggccagataaaatgttaaagatattttcacatcaaaaacatatacttattttaatgagtgggtcataagttattacatattcttgcaaatataattcatcatttttttctctgaagatcactgaacgtaattataaggtacattgcacagttcatcagtttattaagcaaatatttactagcagcctattatatgccaagaatcatggcaggtagtagttttatgctttcagacataattatctgcacacacaaaaataccataaatatataaacagttatatagtgtctactatgtgctgcatttactacatattctacaaatgtaaatcatttcgtctttgcaaatgctctgcaagataaacattatcattatccccattttatctacgaaaaaaactcatcctgcattgcctctcaatatagtataataaattatgattcattctataaagcaatataatattatgctctagaagacaatatcaggagaggcatttctaatttggactgcaaacatttgaaagaaaattctcctaagaaaaggcatttcctgtgattccagagaaatgttccagtgaagagcacaaaggaagaacattccaagcaaacagaacaacatgtgcaaaggccctcacatggagacaaaagaagcctttttaagaaaacataaagagagtgagtttagctcggtctcataggaggacaaaagacataaaatgagttcagagagggaggcaagggctagatcatgtggagtctaatggaaatgctgaagatgattttattttctgtgaaatggaaagtcactggaagatcttaagccaaatgtaaaataattgaatctggaattttaagagtgcatcctagctgctgtgtggaaaatggacttgagatgagcacaatataaagcagggagagtaatcagaaggctttgcagtaacctagctgaaaatacatagtggttttgttatttgtggagatggttagaaagggaagaattcaggaggtatttctgagaaagaatcaaataggacttggtggtggatttagcaggaggatgcataacagagcggtatcttcaataactgccaggtttctgacatgggcatctggaaggatagaggactggagggatgactggttcagggataattgaggaatagagaagagaagcacagagttcaatttagggtgaggtttcaatacatgtgagatatgcaagtgtacatgtcaagaaatgataacatttaaagcatgaggctcaaaagaagtcttggctaaataatttattcaaaaaaaaaaaaaaaaaaacagaaggcttcaggaaaaaaaaatggtttaaagccataggaaaacaaaacaaaaaaaagtagagtagaatagcagtccctgagaaaactaagtaagagcaagtttccatggaaacaggagagaaatcaggagattggactgttttggatgagagaaaaatgtgtcaaaaggaagacactgtgtggagacagggaagatggggacttaaaactgcccagtagggccgggcacagtggttcagaccagtaatcccagcattttgggaggccaagacgggtggatcacctgaggtcgggagtttgagaccagcctgaccaacatggagaaaccccgtctctactaaaaaatacaaaattagccaggtgtggtggtgcatgcttgtaatgccagctactcatgaggctgaggcaggagaatcacttgaaccagggaggcggaggttgcagtgagccaagatcacgccattgcactccagcctgggcaacaagagcgaaactccatctcagaaaaacacaacaaaacaaaacaaacaaaaaaatgcctggtgaactcatccacattatgtaggcagccttgggttgggggggtggggagggcagaacgaatggacagcaggagcatctgaatgcaggcaaatctgcaaagtgccttggctggatgcagagctggaaaacagggtggcatctgtagggtagactgggggtcaagaaaagtctattttaaagctaggggtcactcaagcataagaagactggtgttaaagagagaaggaagaaaaagatgcaggaaatagaagagaggtaaaaaataaagctcgtcgaaaggtagggacagatggatccaggtgacacacagaggaatggccctttaggaaaatgcacatcaacttcattattctaggaaagaagagtggaagctgaccgagccaggtggtatgtggatttggatgatgatagttactgtctgtggcatttgtctcctttaacaatgaggcaagatgatcaggataatgagaggagaaggaaggcttagagaaaagaaaaaacaagaggtaaaatgtcctgcacagatagtaagtcctttttcatgtttattttgaacaagactttcatgaatatcaccagtgtgagaataaagttccagtatatttatttactgttttctataaattcaaatattgaaaactgagtatcttcaggtccaaatgaccagtcccactgcctcttttatcactcttctattctttggttattggatgcaagcttattctacatgttccattttcaaaacaaataaatgttagcatttccctgtattggtaagtaaaaatacagtttgccaatacattaatagtaaagtgaccttagagaattattagaaatggttacaggaaatattattaactgacttatttaaaccatgaatcaccataaaggtacaagttatgcagaaattgagcactgaataatgtattgctcagagtctttcagttggccttgacctgcttttaacacagaaaagtgaagcatctcattaagtgactttaacacaaactgattaaatgtaaattcattcattaaatatatattcagtagtgtataacagaattactataattgcactcatagtaaaactcacaaataatgtacagaaaggaataacttacaaagtataactccctatagcaaatcttactctcctaggaaagtgatgagaaatttgaaagtttacaatcagataagactatatttcacagatatcttagactcatcagcttatatcgtattatgtatgttttaaaaataggttaattttcatgggctgaagtggcagtctttgataacacgtgcctacatactaatttaaaaccacatattaaaaaccttagagcaaaagtgtaatagcaaatatattacagaactttgaaatggtatatggcgagtgaaaagagattgaaggagctctgattttttcatcaattaagaaaatacttcttgtaaaagtgtgtatttaacatgacagagtcagaaatccaaactaacatcacattgattccttttccaatcccagaaaattcaactaagtaggtcactcattagaactgctgaggacaatttctgttagcctgtttagataggaaggcacgtgtgttaacatgggcatctggggtaaaaatcctggagggtttgtatttctactccagcattggggcattctttcctttgcccttccacatctcttgttccttctgccaaaaacactttttcccactatatgtactgttcctctgcctacaatactttttctcccttcttcactcagtcctcatgaaagttttcatgaccttccctgactagattaagtcacccaatactaagctctcttaaatctatctcttttttacagagcaccagttataatttcatatttctctgtatcctagcttaataaatagacccctctattggattattagcccacatggccagagaatatgtccacaccaccactgcattttctgtacttggcatgtaataaacatgctataaatatttactgaataaatgaataatggataaatgtttaaactctttggatgtggactttaagaaaattagaagccagtataaaatgttgatcaataatcaaactatggaaattagaagtcagtgtaaaatgttaatcaataatcaagctatagatttataagtagatgaattgcatcttagctctgcaatatgttgttaaacttgtacattcaaaagtacaaatactctgtccaaatagacattaaaatactcaaataaagatatacagaacatctaacatagagtctgacatacagtagatgttaaatggcaactctattgttttaaaaattattttagtaaaaaggattaggatactcagtactaaaattagaacagattcctaattcataagattcagataaactgcctcagctgtattgagcttgaaataaagttcactaacaggatgatacaagtgtccctcaaacattagtttggtgtttgaaacagtttctgataaaactatgatcaatgcatttcaatacttccaaagaaacttcttattaaatatcccagtcaggtacacaaattgaaagatgctttccagtcaaaacaaagtatcagtatctcaaatgaaataacccaagcttttggttttgtaaaggcagtctctatttttgctctaatttcccctgctgaatatgaaatcattccataaaatatttctgagaagagggactctgcttgtcatcacattatgtcaggatacaaacaatgaaatattcctgttgccttaatacacgctacaagtcaaagaagcagaaagttacgggaagtgccctttgtctggaaatggcaactagaacacatcttcttggagtaccaagtcttcctttgaatggtttagtgcagtcaagtagttctgcactggaaacattaagaattaatgacaaaagacattcttaaggtcacatattctacttgaaacttcagtgaaagagaagtagctcatttattatttgcccactcaacctgtctttttaaaattatttttagttttaaaaatgagaaagggtcttactattttgcccagactggtttcgaattcctggcctcaagtgatcctcccaccttggcctcccaagcagctggaattacaggcatgagccactgtatccagctctcaacatgtctattaattcgcatcccttcccctcagaaagaccgttctcctatgtatggattctaaatgtttaaaggcaggctttctttagggtactttgtacattgtttagtcctaaagcatttttaagaagcaaaaataggacacaactatagtttctgaaaaaattgttcaatatttattacttaacatgtcttaatgttttattttctctatttctggcatgtaaaataaataatggtgcaaaattgttggctcaagccatgtaatcatcagcaaaaataataattcaaatccagacctgactgctttggaaaaggattttttaaattaaaataatattagtacacttatttacacaagttaactatgatggataacatacacaacaaatttatattttgtaagattaaataatttaaataagaaacaataaaattttgcatattagtaagtacaaacacaaattatggtatcagacactatccacattttggccaccagatggcaatgcaggaaaataaaaggaaaatgaccagaggctgtgcgctccaaaattttggctgtgcttgttttatgtacttattcctatttttaaaaaactttcaaaatttattttgattttcatatttttcatagtagatttggactataagagattatatgaaaatgattattctaaaatccggataaaatagctgataacatttattcttacatatgtggatacattcccagttaagagttatttctggaaaactgataagaaataagatttataaagtggctgtttagaattcaatgtctgggtgaaatgttataactgcagtcaggactttggttcatttgctactgtgacttagctgcatttttgtatgtttagtatgtctttgaatttcagaagtcaataaatgaatagaaaagcccagattaatagaaaaaaatgctttctaggttatctgttaccaaattactttccaaaaattttgtgccaatttaaagtatatatgtgctagtttcactgcagcctcataaacacttcccattttttatttgctgaactgtaaataaaaatatttcaatattttaactatttgaatttgattgctagcaaaatgacccttctcatatattaatttttgtgtagttctgtttttccagattgttgcttactatttaatctaaacctatgagcctattcctttactatttcttaaaagagttttgtacttagaaaatcaaccgtctatcagtcaggaaattattcatctgtaaccttactgatgtttcatgggttttggtatatagtcatggtggaatttagtttccccaacactatgaggtgataacaaaattaggcaatttgtttttacaaatagcgaaatttcccatttatgatacattcattcatgatacattccttacaacaaattaagattttgaatacatttctgtaattttttagtcctttgtccctccgttatttcatgagcttgctttttaatatgaataattttaaaaagtattagctaacatgtattgagaatcacctgcgtgccaggctaaacacttgatatccattaagttgtttaactttcaacaagctacagttttagttttaataggcttcccattatatagttgaggaaatgaggtgtacgatgttaaagtgttcagagtcaaacagcaaccaagattcagagctcaaccccaagcgcaaattccctgacgcacttttctctaaggtctttaatcattttcaattacagtttaataacagaggagaaagctaccacatcccgtcatgtgatattcttcacaactgtcttcctactgcagtaactttagaaatttttgtcaaattaaaattgctctcatgagtaaattagaaaaactgctatcttcacatgggtatccttttcattccaggaaaaattattcattaattccaaatatcaaatcttttaaatatatctctcacactcttttctctatctttaatataggtcctaaatatattactaaaagtactgctagttaattcatgacttttgctaatgttgtgaatgtgattttaatttctgtcgttaatccctgtccagggaaaactagaaggtatggtcaccctctcacagtcagagacataaatatcttcactaatgacactcatggagttggccactccactcttcaagttgacggtgctgttcccaacagtggctgctggtttgcggtttccttggtccattgtataaaaaaagaaacatattgagaatgaattatctcttctttaatcaatttaggaaaaccaagtctagtccaggccttgcctctaataagcattacagccaaaactgattcaattatctcccctaagctgcagattgctcctttctgaaataaagggtttttctagattaggtggaaagcccttcaaattctaaaattatataatttacatcagctagtttaacaatcaggacaaaaatgtaaatatggaataaattctgtatatgtctaaaaaatggcaccagtagataaaatggaatacaattccctataattataaagacacgaattgtgtttgcctataaatgtaaatcatcattcatcaaacatttcaataaatattttcatttttaaacaaatatttcaaacaactcaaatcatgatgtaacctatatttagtctgtttaccttgttgaaatcttggatggatttctgaataagtcccaattaccatttttaatatattctttttatattttgatagagaaaattttataattctctaatcatattcatttaaaaacatttgaagccattgaaagtatgctgttcttttacttgaaatgtaaactgaatttaggatccccctgcatctccacctgacatttctgtcttctcaaccatctcttaaccaaccactgtgcactcctgagtccacagcacttttccaactggaaaaatgggcagctttctttcccactccatcattctccaggtacaataaccttatcagtattatttccattacaaatgttttttgcatagccctctagaaatttgaatgccagctcctgaagacaaaaccttaatgaaatgatgaaacaatcacatactgtctgatctggtcccctttaccaacactgtgaagcagacatgaccaatatgtacaatattttcatgatacctgaagctgagtacttggaaaattccctagttgaaaaataaactaaaacagatggctcagtttgcttgaagaacacaataagaatggcatacataactaatgtgtttgtagagcagagatactacaatactgatcatatgagtgaggatgactggccacataagaacacaaagttaacttatcactgattgaaactgtttataaaattctgacatccatctagtacattttttgttcagcactgttctgattgacaaaaggtagagtcaattcaagaaccaccactacgtgccttgaactactctatgtacagtaacattagtacaaaaaagactctctctatactcaaagaagcgtacattcttggagaggagggaatacagagatatagaaaataacaaacatatgtaaaatatcaggtgaagagaaatgatagaaaaaatgaagtgacgtgaaatattaaataaacgaagtggttgaataactaaaatcggaatgctgtctgagagacagtagtcagggaaggcctctctatcacgcagtatttgagcaaagacctgagctgggggaagatctgggggatgatcaggcagctatctaggcctggaagcatccagattcatgtaatggtaagcagaagtaatttctcatctgtacacatctacaagacattcactagacagaaaggatacatccgccttttaagaaagtttattcacatcaccaatgaattcttataaacattaaattgtatctgggatgcagaaacagctgatgacagttatcaactagggttgaaggaattatattcaatttaactcagttccactgagacaaattatatacatctggaaaacttagagcatgattatgatataaattaatgacaaaaagataggtaaagaagatacctatcaaactacatagcaggagagatttcataacattttaaaatatattttaaagtgtgcaataaacatggattactgaacaaaacattacaaaggtgaattagttgtagaaaaaattgccaatatttttatttgaagtttagaacttatacaaattgtcactttatgaaaaatctcttatacattaacataaggtaaaaatattttcatgtcttagcatattagttttcaagctataatatatacatcgaaattctcaaaatgctttttttattcctctaggaatttgatgaaatagatttttattcaacaattaagattgcagtgtatgcattttacaaataagttctcatagtgtcaatttacatttgaatttcttttgaattttaagcctactaaataattaagaacaaatatgatagtttaatttaatttaaagaactctgaacaattctcctacatctattgctcaggccagcccaagtcactctctttacctacactcaaaattaaatgaaactataatttaaaaaatttcatctaataagtactcacatacatgacatcttttcctagtccttcaagccccatcaaataagtcaataacttttataattctaaaaacaatagttcagtttagaataaaattattccctttgcctcaccctgaatattactttgctgtttcctttttacatatacgacgaatttctaagtgccaaaaacttagtgtaccatgtaattaatgggaaaaaaatacttattgtacttgtcaacaccttcttataaactctctttatatttccaaagcaattaagttatcttctggcaactcataaaaaaaaaaaaaaaagaaaaatcctaaataaccttggcggctttgccctgctattataacaactaaatttgtccttttctttgatcttttcttactgtccataatttctttatgtcttttaaatgaaaatacttttataaaggtcccatctttacctaaaaaaagtgcataagaagatagaattcttcttcttttaacaaattctcttaattccatttcttcctgttttaagacctcctcccatccccaaagaaacaaatgtctacaaaataaaaatattcaaacatccatagtattaagaattctataattaccaagctcttaaaatctgagtcagtgaaaaacatgattatttacaacaagccccagttaatcatctgctgaacttgctaaaggtacctctttagtatactgatttcctcttctataatgacgcaaagcccgccagttgtacacacagttaacagtaatgcgataaaaacccctgcacaggaatcacccgggggactttccaaatgcagatgttctccttagctctggagtgcagcttgagatgctgcatttgtacccattgcttaacagagctcccaggcaaggctcagactgcttggctacaggccccacttcgatggcaagagaataaactgcagtcttcttgttgacataaatgagcaatagatcaacataaagttttcctgaactctagatggatggcttttgataagacaagaaattattctcttagatttgtcacaaaactgtattgacatggcaaatatcttttattttctttgagctctggcaaaaagagggtctgttttctaagaaacttttagcactgggggatagaaattgcttttaagttcaaattgtgcagcaatttacaattgtactcattttcataggctgagtagcgaagttccttatctaaaaaagccaacaaaacatgtccttgtctaggaatacattaggcatattttagaaggaaatctgaaatttaaagcacataggaaatggaacaattgaaatcatctcttacttgcctacacagtgcaactccatatttaaacaacctcctgctctggtattagttggtgttaaacaatcaagtcaggaactgaaatgtctgagattttatagcagttgtaagctaacaagtaagcctcctacagtgtcatagataaaaggcagaaaaaatacaagccctctgagtcagagacaaagagtttattactcatagcaacagaggagcagagtaacatctttgtttgcacaagctgcccaaacctcaattcccacaggatgacaggaggacagccaggggtcacctgcataggtagtgagatgggtttccagccaggagtcccaagatgaggaagtccctgatcttatacaggggcttctgatggcccacactcatcctcccctccagagagacacaatagtttaattactctgcattgaaaatctcttcgggagaaggagaaatctctttactatcctggaatgcaaataaatctgaataaattggctgttaatgcttagacttaaatgtgaaagattcataaagaaatgtctcccaacagttggtggaaaaatgttggaagatgacactaaataacaataatcatcatcataatacatgattacaatatataagcactttacatgtgacatttcacttggtactcaacaacatttcagcaagttaaattatcctgtccatttttaagataaggaaactgacagaagccctaggttacttgtgtaaggtcataaaactagtagtttccaaagctgcacagttattcctatgcaattctaccagtccatctaagagacagggttgcctgtgaagaatgagtcaaaccagatgtgagcttactaacactgtccatgcagggataacgtgttggcaggatcattccatcgcgttgctctttacttgatataaaccaacatatattggctccttgaaccgcatactgtgggaagcaaagacttttacaatctttagaataccatattcagaattattgtttatatagacaaataataagcacagacctgtctcacacagaggtctggacccaggaaatctgcaggcttttatagcagttgcatttagggaaaagcttccagctgggaaagggctcaccttcctttccagcctcctatttagctatggttcttcacttttgactttgtacttacatttataaactgtcacttctaggactgctgcttagcgactacaatctggacaaaaggtacaactaactttttaaaaagttatttcctacaagcaagagcaaagatataaggaattatattttgattatttttttttctggtaaaaaatcaaagacagtattttataatgactgtgaattggaaaagcttccacgaggaaaactgactcaaagatccttaacataatcataacatgtgcatctaattctttagtaagaaatgtgtggttttattaaaagacatgaagatctcctttggttgttaacttttagcatattgtctgcaatccatatacattttcccatcatcctccactggcttgcagtattttactcctaaaatgtcaaactccctcacattcataaacaaattcaaatccctgtgtcaacacttgaaattctgcctgcaaatcagaacacgctgtgattgaattgctgctcctatcatctaccactgactcctatcaaagcatataactggattagtgggaaaacagctacattatgcttgcatttcagctttgctaacagcaggcttcctttctgcaacaaagaacaaccctggagatagtagaaacactcagaaatgatgcagcgttagttctgacatcttatacatgatttaagcatgaaaaattactgttatttttaaaaagaatgaaagaaacttagaaaaataaccctaaaaatgagaggctacttgatttttctgtttggtggcttctgggcaactttgggaaagtgttaatatagattgcatcctgagtctttggatgacccacattcttttgggtatgaagataaagagaaatgcatgaggtctctaaggaaaaattacggtcaaagttaactatagaaccactccctccttcctcagtgccttattactatggattcctgaagttacaaaagctaaaggtatattgttgctttcctggactttcaaacagctttagagagaaaataaaatacacatgcacacatgcacgcacacatacaacttgacattataaatatattttgaaggtttttttcctgagaatttccatatcagtaaattgttaaatctgtatttaatgagaagggcctatatgttaaagataaaaatgtaattttacttttttcttaccagaatgttgcataagaatcaattctctttacctgtatcaatttcagacagtatatactcaaaataaagcagactaactcataagactgaaaaatttctttaaaattatgaatttaacgtggttgacactaaagattatatataatgtggttgacactaaagattataaatgcaaataagaatatatgaagtttcataagagcaaaagatacacggtaaagaaagtaaataaatattcctgaagatttagcctcataactttttggttaaatctagaatcatgaatgaagatggctacactccagttctttctcttttcttggaaaaattgctaagactttttctactgttttcttatccgcaatattaagaatagtagtattatcaacctcacagggttgctgtaaagactaaacaaattactatgaaaaacacttagaacagtgtctgccacttgaacattgctttaaaaaaattaaatggcctgtaatcccagcacattcggaggcagaggcgggcggatcacaaggtcaagagattgagaccatcctggctaagagggtgaaaccccgtctctactaaaaatacaaaaaagtagccgggcgtggtggcgggtgcctgtattcccagctactcaggaggctgaggcaggagaatggcgtgaacctgggaggcggagcttgcagtgagccgagatggcgccactgcactccagcctgggtgacagagcgagactccgtctcaaaaaaaaaaaaaaaaaattaaataattacctatcaattatgattaaatagaaggttaatgcacaaataacaaaaataatgaacacgtgtttactttggattttatttgtactgattttctgaggagcaaatctatgtctcaatgtaatcacttaaaattatttagtgagttttcaatcataaaaatgtattaatgattattttgaaataataaaattaaacaaaagtgtacagttaacaaaacttcagagtgtagttgacaaaaaaatgatatttttatagtaaataagagccataaacaagtaaataagtaaccaaaactaattaagcctaaggaggaactaggagctgggaccagtaataccaggagctgaaaccagtaatacgtatctccagaagcagagtggaaagtcactatgacctcatctttcaaatgtcttcctgattatttatcttttaagttccattaattgtgcgtgtttcaatattacttttctgccctgtttatgacatattaatggaggtattttaataacttttaacttgaggtactgaggtgcatacttccaggtgaaatgtattcccagtttttcctacgagtaatatattctgttttcccatatgcttttagctcacacattcaaaccacaccaaatgagtacacccagcttaggatttacaaagagctgtcagtgcatcagtaaagtctgtattaacctggttcacagaaaccacaagaagatatcctgcagttgtgtttcttaagaaattagttaacaattttcttcaaataaatacacgtttaacaacatattttttttaggaaaatcaatggcctttaaaactggcaggctttaagaatcccaatgcccattctaagttctttaggaaataaatgttagttgctgactaaatgttgacagtataaaattcattcaaagcttgcttaatcagaaatcattttaaagcattttattgatagcattattcagtttctaatcaagctagatgatattgatgccctatccatttttccattcatgtcaacccaacttttaactgcctgagattgcagggaaccctctgctgttgcacatggtggtctgggaatgccagagaattaacattacttgggaatagtcatcaactttatatactccagcatatttttccccttggaagggataactctaattcatgaaatctatacttattcccagagaaataagctgcactcactcacagtggaaacttgtttgaagatgaatcatttattaattctctgccttgttttaattcccacatttctctaagtctttcctagagttactttccaaataaaccatttaagcttgaatccttgtctcagtgactattctggggaaaatcaatctaagcagataccaaccagtgttcttagtaagcagaccttcagaatgggattccagaactgaatcatttcctaaattacatacggcaacaaagaccctatttgtacctgggggcacagtcatcactggagtcaaaaaactcctcagatgctatggcaacacaattgctaagattttcatctgcagtgatcagaataaaatactgattaatggggatgcacctagcatttgagagacatggggacaacagtaatcataaaactatgagttggctggttgttgaatttcactgaagaaaatgatagccttatgtcagccaactatcaactaaggccaaagtaagaaagccagaaaacctgtgtggcaactaattaaaagattctcatttcccattttgggaaggtcagcatgtgctagaaatttggctcagaattttcttttgagaatctcagaattataaagtacgctgcattcacaaccttggcagctttctatgcaaaagtcagaacatcaataggcaaggagaagcaccctttgtactaggatgaggacatctaagtggacttcagaatataaaattctggattcccctataccctctggacaggcaaaagtaacctgtgacccttagttagagggcagtagcttctgcgttcctagagaccataaaagatgatgcatactttcctcatgatctgatcctatctcatctaatggctttagacaacaaaaaggccaagtaccatttgacccagccatcccattactgggtatatacccaaaggaatataaatcatgctgctataaagacacatgcacacgtatgtttactgcagcactactcacaatagcaaagacttggaaccaaccgaaatgtccaacaatgatagactggattaagaaaacgtggcacatatacaccatggaatactatgcagccataaaaaatgatgagttcatgtcctttgtagggacatggatgaagatggaaaccatcattctcagcaaactatcgcaaggacaaaaaaccaaacactgcatgttctcactcataggtgggaattgaacaatgagaacatttggacacaggaaggggaacatcacacaccaggtcctgttgtagggtggggggaggggggagggatagcattaggagatatacctaatgctaaatgacgagttaatgggtgcagcacaccaacatggcacatgtatacatatgtaacaaacctgcacattgtgcccatgtaccctagaagttaaagtataataaatatgtgtgtgtgtgtatatatatatatatataattttttaaaaaaaggaaagaatcccaaaaggttacatgacaataaacctactcaaaagttaaaaaaaaaaaaaaaaaaaaaaggccaagtatcaacacggcccaccttgaaaagtacagtctctactccaagaaaacaaaagaagatatttaacaaaagagttgcaggatctgcctaatatgaaccagaagatactgagataatatgccagggaatggatgtttagggttattgaggcaaaatataactggccatcaatatgttgtggaaaataagtaacctacaattagaaaactcatggactcctatacagttataaatggcatggctggttgtccaaagtcctaaaaggatcaagattagaagatgttcctcatacatagttttggagaagcaacatgaggatggacctatggaggtaggcatgaagcataaagatgtctttgttttgcatcaatgtgtgctagagaacattcgtcacagaaaaggcactaaacaattgggtagataagatgatctgtccactggagatcatccagctctgtatgtgtcaactgtactgcttgcaaaataggcccatgaatggaggagcttgatagtagagagagaggatacacatgggcctaaaagctcctccagtttgatgcaactactgccactggtaaataaccaacccacgggaatagtgtgatgctgagtcctcattatagtaccacttctcaaagaaagcaaccagcaactcgatgtaaaaaattattatattgcattttacccccttggagaaggggtcaaatttgtttttcctattatggatacaaattccagttatgggttcccctttcttgttcacagatgaggtgtcatcaagtatcactaatcctcaggttcacaaatactgactgatttatcgtgggatactgaataacatctcaaactaagcaacacatgttatagtacagggagtccaataataagcacatgaccacaggactcacagggtctaccatatgttgcatcactagaggctgccagcctgataacattgggacagtctcctctaaaggtacaactaaggctccagcttacagatgaaaatctgatttggggatgttgtcttcaaaatgcgatatgtattttgaaccatggtgctatgtgctgaagccagcttgtaactgctaataataattttttaaaaatggttgaaattttcacgaaacttaaaagccagttaacctcacattggtagcttaaaattggtcatagtgggaatatttgcatcatgaaaattggcaaatgctacacatcaattttctcctccacccccctggctttgcccctaaaaggcagaatgtatcaatatgaaaaccaagggggtaaagtaggaaagtcccctcttactataattaaaagtgacccacttgggaaaggtgtacttcttgtcattgagacttcaggctccactgaaataaatgttctgctttccaagtgtgtatgtgttgggggaaaggggcaggtaatgcagtgctcctatcagggtcccagaaagaatttaactaaacctaaatctatagctactatctgaatatgcttcaattctcatgccagtagacctacaagaaaaaaaaaaaataagtgatgctactggcagggttccagttgacaagaggaatatcatgggtgttgctgctacataatggtaagagggaacttgggattcgttcaagtatgtctgtggttggagataactgtgaatggacaactgcagaaaccaccatttgaatgggcacagaaaccatggattcataggccccaggaggagtaagagtctggttcctcctatcaggcaagccaccagcacaggagttggccaaggctgcagggaaattaggaaaggtattagaggaaagaaaagatgagtatgaattatgtccttggttctaaatctagaagtccaccatcctgatgttccatgtttctttgtttaaagattgtgaccagtctccatctttaagaatcattgactggatagactggatcctgggccaggcttctaactaccagcacctacaactttttgtttcagtactccctcttgtgcccagtctgtttttcccacacacagggaaggctgctacctaaaacctcagctcctttgcatttggggcaggttaactctgaagtgaatattacgtatggcttccagaattcctcagagaattaagttcctttaaattaaagtaagattctgtcattgtttccttccatccactgcctgacttctttaagtagtagtgtttcctgtgatcacctcccaaatacactatttatatttgaatctgcaagtgagattcagcttctcgaagaagtcagaataagacattcaccacattgaatatctgctagttttatataaatttcacctagatgtcaaatctgcactggatttaagactttctcttttgctatgccacagatagtatttttaaagaactatcccaatggtttgttatgaactatatgtttatatacaaataaagccaaataagtatctttcctgatgatcttatttgagagatcaagtattacattctacttgtttgcattctgttgaaatacgtagtgagctgacatacagggtcagatagattgtaaaatcagacttaaatgaatcagagatcttatgcagtatcaagttttaataaataatgttgagaatatgttgagaatatagacaagctaaaggacttctgaaggttcagatgaagtagatagaggcctcacacggaggagggcttcccagctcctccttcctgtgctgaacacattcttcttgcccacatgaagggaaatcacaaaaagagtttcacagggctccttgtaaattataaaatacttacagtttattccccagagaattatatcacctgtgagagtgttttgccaggaaccttgccttataggtatcgtgttttcctatacctactcttaggccgcgatacaccactaaaaacatttcagggataaattctcttcctcctagtaaatatcaataatctagctacctggagcttcaggtgagaagggactaaacaaagtctcctgccttcttctttctagtctcccttggtgagtaaatcaatttcagaccagctactttaacttcttcctcccaagtcatttcagagacagatccatttttcaatacaaaataacccttaccacaaattcctcgtcttcacatctctatgaatatatttacctcaagtgtaaatatatcttccagaaaatggccatgaaatattttgcctaaattctatgaattaaaatgacacatggtaacatttgtttgtcttatttcatttgcttcatagttcagtactttctagctatgagtaggagggtctatgatggttctgaggagactttaataagagcacattcaaatatctattggtttttatgttaacaagaaaaacatactataaaaacataatacattatagatatgtgtccaagatgaaatgaggatgataatgaatagaaaatgccatataatcatactgccaagttgctattttctaggagtttcaacggtgtccgtgagtaaaggggctcatattacttatttaagctcttctgagtgaaggaggatatgtggaatgctttttatttatagtcattacttcaattactttaaccagggataaattcttagaaactcaaaaaggctcctggcatagaattataagaagatccacgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagatcacatggacacaggaaggggaacatcacacaccagggcctgttgtggggtggggggaggggggagggatagcattaggagatatacctaatgctaaatgacgagttaataggtgcagcacagcaacatggcacatgtataaatatgtaacaaacctgcacgttgtgcacatgtaccctaaaacttaaattatatatatgtattatatatatataatatatatatataatatatatatattatatatatattatatatataatatatatataatatatatatataatatgtataaaaaaccttaaaaaaagaattataagaagatcagtcgctaaaataggacaggtcagtaagatagtcttgcaatatatcaaaaatgtctcagcctctataagataaaagtataaagtacctaaagtcaggagaagatagaaattgcaaatttaattcaggaaaatgcagtcatcttatacttactgaagctacattcacgaaatcatcatctgagagggtttctaacatttcggagacagatgttcggatcagtttaagtgtcaatccactaacacttccactcctagaaatagacaaatgggtccatacatgttactcatcatgtatttaatcaagaacatcataaggaaagataatgtatgcactgaccctagatcttttatatattatttaaataataattttgcccttgaaaatcagtttaaaaagttacattttttgatagaagtggaaattataagaaatcctgcctttttttcctcccaatatcagtatgtgtacatttctaactgaaattatcaaaattacatgttaagtgacaattaaaaaaaaatatggatactgatggtatagtcactcattcggttctgttagccaagttagaagagaggagtagagagattaatagacatagtcattgctccagggaacccattgtttgacttgattaaaacaataattataaatccacataacaattatgataacagatttgcaagaaaatgccttgttctgcatcctaaagtaaatatcctctagaatttattcttcatttttctttcctctacatattctacaatacttggtgacttcacctatgtgcagggctggctcaactctaggcaactaacccccacttctacatctctagctcccaacactttcctggttttatccttcgagctgcctgctgaaccactacgactgaatgtccaaaatgacacattacttccaaacatatttttcattcctatttatgttcttggtaccaaagagtctatgtctcagccatccaatttgttcttccctctcaaccttcctgtgcattcaggcaaaatcccttattcattccacttaagtgttccaaggctatggtcccctctccatcctcactcctctctggctcagtcttcattatacgaagatgctgagctacagtaatagccagtcaacccagcaattagtctccttcacatgctaacaggtgaaagttctagaaacacatcctgacctaatatttttaacagctcatagataccgactaaatagccagaaatctcaatagccctgtattccaatcctttcattttggcattttctctctctcctccctgtaaccacccaacaggttcttcctgcccgctgcactaacaaagaccatggcattgcagtaaagaaagagtttaattgatgccgggccagtcatgccagacaggagatggtgttattactcaaatcaatctcatcaaaggctcggagggagattagggatttttcaaagacagtttgatgggcaggggactaggatatcagtgctgctaactggttgaagatgaaatcacaggggtgtggaaaatggccctcttgtgctgagcccacttttgggtggggagcacaggattggttgaggcacaggtccccgtgggaccatctgctagaaatgcaaaagcctgaaaagatatctcaaaagccccatctgaggttctagaatagtgatgttatttacaggaataataggggaagttgcaaatcttgtgacctccagaataatggctagtaattatttaactacatctacatcttagtagaattcaagtttctcttatcctataatttggtagcctttcattagttttataagggcagtttcgttttagggaagggctattatcatttaaactataaactaaatttctcccaaagttatcttggcccacacccaggaatgagcagccaatcagcctgtgaagctagaaacaagatagaggcaaccatgtcagatttgtctcactgtcaaaattttgcaaaggcattttcaatcctctacctcctccataaatgtccccagacttacctgtgcagcttcacttctggcaattcttccacctgaaattccactgtctttcctctcccctcccatgcttgcctttgaaaatatgagccatgaggattcaatcccaattttatctccttaatgctttcctgatacattaaatcaagttgctatctcttatgtattcctttagtgctatgtcatactttatatctattaatttctacaattatttttgttatttgttaaggtctagtttacctaatacatttgaattatctttgagatcaggtactatgtctttttttttttttaatatactttaagttttagggtacatgtgcacaacgtgcaggtttgttacatacgtatacatgtgccatgttggtgtgttgcacccagtaacttgtcatttacattaggtatatctccttttttttttttttttttttttttttttttgagacaagctcttgctctgttgcccaggctggagtgcagggtatgaacacaactcactgtagcccccatctcctggcctcaggcatcctcccacctcagcctccaaaatgtagctggaattacaggtgtgtgccaccatgcccagctggtttttcttttgtatttgttgtagaaatgagatattgctttgttgctcaggctggtctcaaactcctcggcttaagccatccacctgccttagcctcccaagtgatgggatcacaggtgtgagtaaccacgtctggtctcagtaactatgtcttaatcatctttgtttctatgttactacactgtgtgtaggaagacctcaatacatttctgttgaaagaatttttgaaaatagtatttaaatttcatatacactttcaagtttgggatataaatttggcttctatagattttgaaatgacattatttctggatattattatacatccaacaggattataatatattgcattaatatattgatttatacttaagaagaatatcaaggattagcatataagatccataatttaattaaagtaacatgaggcttaaatgcatcttaagaaataaaataagaattaacatttaaattacatttgttgaattcatttatcttctctttctcagactgggttatgagggtttggacaactaaattaaattggtttacttgagcttaaaatggggaaaattcaaatgttaatacttgcctgtgggatttagctgtccccaaattactagattttgtttcttccaatgagacaaagatttttttttttttttcctcagggaaaaacatgagcatttcttctcttgaggaaaaacatgagtaacctaagcattttacacttcatgtttattttaattccttgattattgctctttaaaaaagtaaatctccatagcaggatataatcttttcaatttctacatcttcaaccttattagaaaacatgtacacttgcaaacatacacatatatcttgaattgaagcactataacaaagagaccaacataaaaactcaaggaattattttttgtatatcaccatttcacttttaaaagtcccagatttttttttttttcttttctgagacattgtctcttcacccaggctggaatacagcggcaggaacatggttcactgtaaccttgatctcctgggctcaagcaatcctcccaccttagcctcccaagtagctggaactacaggtgtgaagctaccatgcccgaacaagttccaacattaacttatttaatatatttcatatttaacattatatgatatgtaatattaatatatgaatatccatatagattctcttcatgtttaattaaataatttgttttattattgtcttgatatggcttcattgcctgaatataaaagtcatcataatttttctttgtttcttttttaacctatcaaacctttcttagtcccaccatactactgttatctacaaatcctcccatattctcaatatataaataagtagtatttaacaactcacacatccaccagaataagcatgtctttaggagatgcagctccttggatgtacctgaaacaaatattgtaataaatgcttttctcttccaaaatatcaaacactgatatttgttgaattgatatttactgactctgagacaaggtttttttccccaagcaaagacccacttctatctaagtagacaatggttttccattcatattcttcaatgtcagtttgataaaagcaatatccaatataacaatagagatgtcagaagcataatatttaacattttttgatatttataacagaagatgaagaaacatattttaactttgagaagaacatttttcctggaaaaacaattatctaaactccaattgttgaccacaggtttaaaagtcactttaatgaaaaatagactatcatatttttaaatgtaaaaaataagcacaaaaaatagataagttgcttaggaacatcaaaaagcaatatcaacaaaaaagaaatataactggccaataaagagattaaaattaggcaatatgtgatgttattaccaagaacttcaatggctctcaaactttacagtgtttaagaatcacctggggaatcagttcagaatattaatttccaaattcaaccccgtggaatcagaatctctgcattttaaagagactctagaagagatttatgcagatggttcagtggttgtggagagagatcatcttgattgtgtatgactgacccaaaagctcactcacgttgcctggccaccgactggaatggggcctgacttctccgacaggaagggctgcacctgacatcaatttttttacttatttctgaagccatcactgtaaatgtaacttctcaggaggctgccagttaactttccaattagttttcagacaacatacagcacaattagttctatgtgttgaggaagcagttggagtttgtaacctgcacccttgcttgataagaaggtaaagtggcagagtggcaggtgaattttcatggacagcaaacctggctgatgcctagtatcttaatgctggtccaggtatgccactcagtgggaagataagagaagacaggacatgtctgcctctactgattggcacccagcttctaagtctcctccaaaacaaccaattcctgaattaaaacaagactatatattagtttttagctccactcaacagccccatggctccacaggaagaatatgtaaattagtaataattgtcactattaaacatggttggtgtagacataaattgctactgggatatttaaaaggacatctaaaagcctctaaatacaagtctttggaatcaaacattatgctcttgcaatttgtctgaagcctagaaaaaagttagaaataacctaaacgtccaataataagggatttcataaataagtttccatatagtcttcattcaaatgatggtatgtgtcttttctcatgaatatgtactcaaaagttattgatatgaaaagtgtgggatacaaagcacttatactgtatatgtgaactcatttcttaaaattcacacattaaatacatttttaaaaagcaaataaatacaattaatagttttaaaaaacccaaaaatagttgttttccagtaagtccaattacaaattattggtatttttccagttttatgttaggagaacaagttgcttcagtagtgaggaacaaataagtcttcattttggaaaaaaaattaaacctaagctatatgaatataactaggggcagcttttaccttggggccaattctcattagttcactgccagaggcaaattatctcctactctatctcatctctctgttggagctctactccaagcaaactggatccctgccatagaaatccataccagctaagaggtgtagtactgagattaaatataaaacttaaagtagtccatttgaaatgaatgtgataaatgggttcacctatattaattagcattacccacttgaactcatcattttcatttacctttacctatatttacttatttttaaaaatcagatcactttcaataagtagttaatactcatcctaataataaaaaattctgactttttagcaaatatatatcttcttgcctattttatcttttcatggctagctaaaaattcttaccatggtcttctgcgtacatcataaaggtcaatcttatttggagttctactattatcaacccatggtgaagctaaaaaaaaaaaaaaaagagagatattaaatcaaaatattagatatgctctaaaaataatgagactttaaaaatcacaaaaagcaatagatacataatttcacttacgtacttcaatgttcaaatgagagatatcatttttaagcccttatattgctttaacatggaaaacaacacggcagtacaaaaaggaaatcaatgatagtcgattctctttttacgagttatttcagaaataaatttacacatacagtttttccgggtgctaacttaatatgttttagtaggtgtccagaggttataatttttttcctaacagaaaatttatgtgccactaatgaaaattgtgctttcaattatttcctccttatattttcgttcaatgccatattctcttggtctatataagacagctgtttttcttgggtttttatgtaatagcataattttactcagtccatggtaaaataactaaaaggtcagctataattaaaacaactccatagaaagctgttttctttaaatttattgtaatgatgtgaagtaattcaagcgcagattcaacaatcttgtatgactttcacagcctttatctttttgcaataatcagaaataacttcatctaattgtattgatttttaaatgcaattaatttaaatctattctaattaaattgatacttactttaattaaaatgctttacaaagctttacatgcatgcacaccttagacctaatgaaaaaaataaatgctgatgaattggatgataatttcatgctgaagtagtccccgtacttggacatgtttaaacatatgactcctgggcaaatgcctagttcatatgacttacgttccccaatcaatttcgcttttctgagaaactgtggaaattatgaagaactttactgagagtcaggtttattagccaactaagataatttggccaattaggatatgtcaaaaactatatacaatgaaactcttccttgactgtgaaatttttttcttattagtagctatattaaaaaatgatttatttgttctaaatgactaatcatatttacaaagaatagtaagcttaaatatagcactcttccaaccattattgacacaatcaatgtaactgaaatggtgagtttactgcaatttgttcaatttgcacttgcagaaagtgagagtctgcgatgtaaaataatcctttttgtgtgtatgtgtgtggtagcactagaattaagtaacaagcatgctgatacacacatcagttcactttcattatccctctatgatatctgactctccaagatagggtcttagtaatacctaaaattttatagaaattgtatcctactttcagtaccatgctatgctgataatacatttcctgccactcaactccaaatgcatccttctaccttgccctatgaaaatggatctgggccctttcaatacttttcctttatcagatggcacaatttcaaggtttgcctgcaaatgatgcaagacagacactgaatgagaaaaaggatttttcttccttgttctggtttgtttgctcacaggctcttgcagcatgtgctgctgtctggtgtctgtctcctgcactgtctgtatattctccagagctcagctcctacagtgttgcagtttccccagattgcccacttccagcaacatggccagcttcaccaggctcaggctctaattttgtcacctgtacccctccagccccgccccctgccccagatatttttgtagaggagagcttacaaggaaagacctggaacctcagagggtaaatttccagcaaatcctatcagtgtggcataacagtgacttctccaccttggtgggccatgaccatggcctctacaagatgttaacctcagcccaggggaactgggggattaggacctctgccttgggcactctatctcaaccctagaggcagttgttattacacattatataatattatatcggatattcataaatcctttagagttctctgtacttctagccaatccctcattactccaatccctactgtagataattttttattgaaaaataaattttccttgttcaaaatgctgtattttttctctcttctgattgaacccagactgacacaaaggtagatgagagaagtgattagttaccactgccaatatgacagcagcaatcctgagttaaaagtggtctgcaacgaatctgataaacaacttaaagaaattggaatttgaaagttatgtttcaattagatttttgaattgtttaccgatcacattcatctaggatttctgttgtcactaccattgctaattgaaattaactgtgatatatattactatattccataaaatgtatatctttaaggaaagaaaaaagttaaaaggctataatttacagtatgagccagactattacattttaatattgtttataaccttaggtggtttatatttcaaaatattaataatcttctcttagaggctttctgagatatttactcttaggtagtatcccttgattaaaccaaattaagatattaatgttatggtaaaattgaacaacataatttcttctgtgatattactaattcccttgttgtaaaatcccatcatgtcatttaaatagttcattccttatataggctcagaattatgaaagatcaaagagtaaaaaggctaataaccatacaagttaattccctgaaataatcagtttcataaccatgcacagtgaaagctgcatgtttagaaagggaaagagaacttccaaaattcctgtaaaaagtgaaatgttgctcagtttagatgactttttagtgtttcaggaagatttggggatgggcagaaaagagaactgaaaatgacagttcacaatgtagacgtctcttttttgaatgtcatcattaaaggtgataacaatgatttacaggaatgttttcccctgatcaaaaatgaactgttagtgtgtcctttactaaatctactggtctaccatttacttcacctgatacataggatgtgttacgggtgttatcaaattgttgatttaagcaggtatttacttgtgcattaactcagaatactgatatacgtaataggaaaatattcttgagaaagtacgcagattttagtgccattttctggttaacatggtctaaaaataatagcgaagtaccccttttttttttatttcagctgctaggaaagaataaagcaaataatgatgcattgaggactgattctctcggtagaaacatcaaatgacagctaattgcatttcccaattaaaaagttcaaatgtattttttctaatcctaaaaacttcacagtcttagtctcatgataattttaaaaagtaaatttcatatactcaacaatgcctttaaaagtcactcctggtcctttgcctagatctaattggtggaccattattttcggtttgtctcaatcatctcctatagagtattagtcatggctctgaactgcaagccaagataatcaattgggactattttcaagcccaaattatttcactaaatgtgtactgcatagctcacaaaatttccataaatttcagtgttgctcaattactatcatcccagaatggatcctccacagtccctaatttgcaccatggctccaataaccaagttcagggtagatgactgtcattagaagaatgtggattatacccacacaaaggtgccaaaaaatctaggaaagcaaatagctggccttttcagattttgagttatctgctcccgaataaaacttttaacctgggaaatacttgacatacaggaacaagattctatgttacccatggtggcacaaatgccttaatgaaaaatctgaaatcttttgtatcttagtatagtaaagtacttctaactcaaataacaggctaagttgcgcagggtgtggagagtggtagtgcatggatagattctgctccaggcagttatgcagtcttaaagctgggagatcttttgcctccttcagcacttggattccaagggcatccaggacattgggcttgcagctgctagatggagggaggaagtgtggagaaagcagtctcaagtcctaaaagtctcaggctggaagtgacacatattactttcactcattctctattggtatgaacttgtcatatggtcctacagagacaaaaaggtgggagaaatgtagtccctggctagggagtcttatttaaaagaaaatttcccaatggaatgggaagacagaactttggtggacagctagcaaccttggtcacaggtacaaatggacaatttaaaaatgagtaatatccagtacctatttgaacatcaaattttctgtactcagcaatgtcttcaagtaatccaccacagagatgacggagatgaggataagctaaatttagaatctaacaaataaataaaacataccagtattaagaattatttctagactaaattttaggactgaagtggcttgcacaagaaatttactgatgaaaagaacaacaactagaagtcatctgggcattgttgttgatgttgtgttactaacgaaaccacaaacctgatctgcggcaatgctgtagttgaaccctaaagcaacttttgggctctaaacctgcaccagtaacagcaagcaataaaagctgtttagcctcaagcacacccctgcagatgtgccagaaagtgttttagacaagatagttaatcctagagaatactaccagaaacagtgagatgagctaaccaagaaacgtagctttatgcaaaagaaggatatctttgtatttcttgcctgatagaatgagatagggtgaatgggtcagtgattgttctgtatttctcactctcattttgcagatgggagtttttatcgtagttacccagcagacatgaccaatgaatattatatatttgggcagcaatgggaatagggtagagaaaataactggcataattctgtattataggtagtcaaatgaggaaacatcctacctgatggagagaactgcgtgtgacccagagatcctggattttattcatttgttgagactttgaatcatctatggggaggagctgaatatgttctacacgtggaaaaaaatggtatgcacagatacttgaaatgccagaagaatggcctgtaacagggcttcaatatgcatttcctcctccttccttctagtaagagtcctcaagactgccctgccagaaactatacttttcagtttctcctgtcatgatgtagccatgtgatcaaattctagtagataggatgtgagcaaaagtgatatatgcatgactcttcaatcactcttgttgccttctactaattttcctgtcttcttttggcctcaaaagttttacggtggtattgagcccattttaatcagacagatgaggacaacaacctaaggaatggcagatagctgaaacctcagttgctggacaacatcatggaccagggttaccctaagcactgatttacctattcggtaggaatttttcctccgagtattttttaaatgtttcctttgttatatattattaagtaattgaatcagtaccttgatacaggtcaggacttttctcaatcatgccaacatgggtcaagcattaaagctttgagaatgcaaaggaggcaaaaccttcatgtggtgtcttgaataactgatggagtacaattggaatgttcataatacaaagagatgatgaacacttgaggtgatgaataccccactcacccttatgtgattattagacattatatgcttgtatcaaaattatatacctgctatgtgcccataaaaattaaaaataaaagtaaaaaactttttaaaagtctgcttcactgtattgctctcattcccatgtatttttaggagagtattattttgtccccaggaaactgcttattgctatataagacttctagtgagtcccaaatacatggtcccaagtaatcagttacttttgaaaaataacaatcattcccagatgaaattttcaaatgctgaatgtctaaagctttatggcttagaaccatcaaggagattcacaagcagaagacaagacaggaaagcaagcattccaggtgagtaaatattaatatgaagagtccattctgttgtcattttgaaattgtcttccctggttggacctagcctagtgtagaaattaaaatcatgaatttgggaaccagcctacctggatttttcactgggtgcatgaatttggataaattaacttttttttcagtaaaatgggactaataatgccacttactaggattacagctaagacttaatgaattttacacataaacacttagaaccatagttggcacaaaataagcactccatttacagatacctgaaacagtaccactgagtcactggaactatagattatagatatttaaaaatagatttttataagatatgcttagatgttaaccacttaacatgttcctgtgactggggcttgaacatgatactattttcccatcccattccacctccctgatgcaggctggtgttacacagtcaataaaactttctaggaatctaaaaactgacttcatgatattatcctcagaaacctcatggagaatactgacatagatgagaggacaggatgggcaagatgtgcagacagggacctagaaaacagtaactctatgttccttaacattctccaactgcttgttctccttgtttcatttttatttagaaactgatcctctaaaattctactctaaaactctctttcagttctagtacttatgatcttgacttgtttatccagcttaaaaaaatacctattatacactatatgcacagaactgtgttaggtgatacgaggcatacaaatatgtaattaactatttctcactgcatagattgaaatggtttttaaaatggcatatgcaaaataaattctggaagaaggtaaaattcactatctattgtaatatacataaaaacaaaattatctgtgagaacaaaataaagaaagattgctttgggggcaagtcttcatatgttggtattttatttattttattttaatttttttgagatggagtttcactgttgttgcccaggcgtgagtgcaatggtgcaaccttggctcatttgaacctctgcctcctgggttcaagtgattctcctgcctcagcctaccgagtagctgggattacaggtgcccacaaccacacccggctaatttttgtatttttattagatacggggtttcatcatgttgaccaggctggtctcgaactcctgacctcaggtgatccgcctgcctcggcctcccaaaatgctttgattacaggcgtcagccctcactctcggcctgcattttattttgaatgaatgataagatgcacacaaccagagatgggctctaggaactaggcacatagagacacgaacacaaaaaggcagatttgtagaattgaaaataaaacaaaaaaattaaaagtggagaaaatataatacaggggtaaacaatgaagtttgaactgtacattaagagataaaactggaaacgtagattgagttagaatctttggatggtctgaatgtcatggtaagagagccagatgccattaactagacaatgccagcttgtataattcaccagacagctgataatctaactctaccccacatcacttttattacttttttattttttgagatggagtctcagtctgttgcctaggcttgagtgcagtggtacgatctaggctcactgcaaccttttcttcccaggttgaaagcaattctcctgcctcagcctcctgaggagctgggattacaggtgcccgccattacgcctggctaatttttgtatttttagtagagatgaggttgcactatgttggccaggctggtcttgaacttctgacctcagatgatcctccctccttggcctcctaaactgctgggattacaggcatgagccactgtgcctggccctccacatcattttgaaataattttactagcactttgtttgcattatattttaatgtgtttacaagttttccttttcatccacctgtgaactcctctagagaaaaatcttctcttactggtattagaatcctcaggatatctcagtttcttcagaaacagaagttctgccttgttcttatcagtctttcctccttcgtccagacttaattacactgatctaatcaaataattttgaattttaattttgtttctgggcagtgagtctcggtatttaggatattcagatcatatcactatattggttggagagtgactttgatatttccactgtaatatttccagaatttttttttaattaagttctggggtacttgtgcacaatgtgcaggtttgttacataggtacacatgtgccacgttggtctgctacacccatcaacccgtcatctacattaggtatttttcctcatgctatccctcccctagtcctccatcccctgacagaccccagtgtgtgatgttcccctccctgtgtccatgtgtcctcattgttcaactcccacttatgagtgagaacatgtggtgtttggttttctctatttccagaagttttctcaaacttcttataaacaataggcagaaacccatacacagatacatggtattacagctgaggataaatcaccataattaaaaaaaaaaaaacccttattacaaagtggattactggtaatactgaagatgccagataacacacttaaagcatttttatttaaaggggtatctgtctgtcagcaggagtagcagtcaacagggaaaagtcgggtagttaaatgaaatactcaataaagtaaatggtacacaaacatttaatcctttagatgtcccataatgcagtcattaagtgacttggaaataagcgtgagcacagtaagttctatgaggcaagtgttggggaggatttactgggaaatgatgttagatatgtgctacacagacaaaaacgtgaagtctgacagagaaacatgtttcttatttttgtaagcaaataaattcaattagatgacaataatgacattgctaaaaacataaaacaaactatgattctacaggaacaagtttcctagttctgtaagtgaaaatcttagatgatggtgatagtgatagatttctttaaaagtttatatttagcatatctgagaaagtgcttgaaacatctgagtttttgacaaaaaaatctttttaatttttcataatcaagtatactgaacataaatgaattacacagcaaagatgttctatgcatctaaaaatgaatggcataagtacagaaatttggtaacacagaaagaaaaaagaaacagattgagagatatatcttagaagttgaaaacagctaaatttttttagcaatacttatttacatattttgcatataatgttatccccattcaaattacaaatggctctcattttcatattaccaacctgtttacctactctaacctgtgagcaataaaatcaatcatttagtcagtttaggtatgactgcatccttggttgaccataaggtgaacaattattacgaccattatctgtgaaaaataagacagattcaggtaagagataaggttatacaaaatgcaacaaaaatgctacagaattgccttcataatcatgatgaaatcagaattttaaaacagtatgtcatccttttgtgtatgtgtaaaatgcatccccacacaacacaattgatggatagtatacagcaaagaaaaccacgtaatatgaaaccagtgcttgagcgtaaacagagctatttgtaccctcttgtcaacacctcaaactttactgttctaagttaaactcatcacttttctcccaaaataagaacttttgatttttaattttggtaaacagctttgatattctcatccattcaacttaaaaaatgatactcaactgacactctacatcagtcattaaattcatgtttttaaaaaataaagtctgatatcatcatttctatttaagaattaattcctatttgatccctttttcagatctttaaaattccacatctgaccattaaaatagcatatcttctggtcaagcttccccaagtctttctccttctaatcataatattaagtgctttaatcattgcattacagtgcccaaaatgtttgtggtactttgcctacacattaaatcccaaaccattctgacattcaaggcgacatattctaccattaataaaccttttgattcaatattactttttctataacaaactattggattaactgacctcactagtctccagcagtggttattcatctccttatatttttattttatgccattcttccctccagaaacattttgccttctcttcttcattgacttggttttcaatccaaagttcataaacctcttatatgactctaatccataattacctcttctttttcaaaatttctatagcaaatctattgctattctatttaagtgacttggcatttagtcatttaataatttgtattgcaatctaaatttaagatgtatttaatttagatgtataagttgactacctaattaaatttaaattttctaaaaggcagaaacaacttgttattttaaaacacaaatgtccatatagtaaccatagcagagatgctttttgttccccaatatctgttttccttttcttacttagtacagccccctgccatttagctggatatatggccattttgaaggtaactatgaccaagagaccactaaattctggccagaaacaaatgaaagaaaatgctttatgtgatttccgggaagttcccttaaaaagggggcaaagaagaataccattctttgctcctaataaagagcacaagtaacaacaatagactctaaggcagagcccatgctcagagaatgacagagtagtgagatctgggtgcagaccccttatttgtgtagtttccctacctgccccagtctacgttaactctgattgacatgagtaaaaaccaaacttccatagtgttaaaaatcactattattttggatttgcttcaactggtagctagtaagagtcctaactaatacactggactttaataattattagcataaaatgtaataaacacttcaatttaaagtttatataatgatcaacaactatatacatttatagttgaactatgtgtccataaacaaatgttaaagtaaaaaaaaaaaaaaaatcaggcatttttagagaaaaccaaaagcagtacttctataaatactataaatgttgaggctccactggtatcccattttcttctagttggctaaaaatagatcgaacgcttcatttatgactaaactttaaaaagtattctttggactaccttatcatctgctatttgatgcttaaaatattcctaaattattgttcaaaaagtggtacacaatttaagagctattggctacctgtatggaaaaaaaaagtcattccatatactttgtaagagattcttttgcattttattccagcaaaatcctagcagaaatagcaacaagaagatgtctctcagaggtctactttacattaacttaatacacattaggttcctttattgtaatctcatagttttgaaattaacaaacgaggcagggcagagaaagaacaaataataagacattaagtaaacgtcatacggagatgaagtagatttttagttttctcccttttttaataaatacaactaattgtctaaaaaaaagagtaagtgctggctacattggcatttcaatgaaccactgattcctaataacaatcccaattactgcaacaattggtacaatttcaggagatattaacaggtgaaatgaccagtttgtacctatggtttttatgatgcataagaattcacaaagttgatagctattgaaagcagtttttaatagctttaatttatataaataagttaagagcttctaaaggaaagaacttgcaagataaactgattttccaatgagcacatattcaaggaagacatcattaaatatgagttcctaatcatatctatgtcatgagctagctgtatgactagggctagtcattctacttatcttgcaaaacaaagactgtggatgtagcaaatgctacagcaggctataagcagataaaactagtgcttgctttagaaatcattttgttcaatcatcccaagttactgatgaagaaacaggtacagaaatataatatgacttaaaagtacaaagtgacggtgatgacagcttttataagaacctagaactcctcatagtctacctgccttccaagaaggagaggagaaagaggaagaagaaagagggtggagaaagaggaaaaaaagaaaaaagaagaagtgagaagaaaaaggacagacaccaatgattttcttagcttatttccatatacatcaatgaaattataaagcaggttcatgttcagtccaaggacagacattaagagtttaaatctccattaattacggaactactgttttgagtcagcactgcataggtacctttatattacgctagctctagagatctcactggaagtcagtgtttctatgtattttaaataatctgataaatgaaaatcatgagagtactctaactttcccctacatctgggcaatatgctccaaacagatttaatgcttcttattctcttaacaattataccatctaagcattgttatcctccttgtttcacagctgaggtcaatgaggactttccaaaggtcatcatcatacaaagtatactggtggaggtggggtttatattctggctatctgattcaagaatataattactgtggaatctaaaaaagtctatcttagctgggtgtggtagctcacacctgtaatcccagcactttgggaggctgaggcaggtggatcacctgaggtcaggacttcgagaccagccttgccaacatggagaaaacccgtctctactaataatacaaaaattagccaggcatggtggcatgcatctgtaatccctgctacttgggaggctgaggcaggagaatcgctcgaacccagggggcagaggttgcagtgagccgagattacgccactgcactccagcctaggtaacaaagtgagactctgtctcaaaaaaaaaaaaaaaaaagttgacgtcatagaacacagagtctataatggcggttaccaaagactgggttggttacaagggaggaagagatggggagatgttggtcaaaggacgcataattacagttagagaggaggaataaattcaagaaatctatcatataaacggtgactttagttaatgatgatatatagaccataataataactatgttaggtgaggctttgttaattagctagatttaaccattctacaatatgtgtgtgtatgtcaaaacttatacatattatctttcaatttttaatttttttatttttaattattatgggtacataatactgatggggttaaaaatatatatgtgtgtatatatatacgtatatatatgcgtacatatgtatagatgtgtgtatatatatacatatatgtacacctatatatatatacacacctatatacctatatatgtatataggtgtgtatatatataaaaataaattgctcacctgcctctttgtatgtgactctgctttaagtagcatattaataatcaacaaggatattttttagcttctattgtgaatcagaaggttctagttcctgcaaaatattttattttcaatagctctgtggcaagtattcacttacaaaaataaaaataggtagcttacagaagttaaaaatgaaaattataaaattctatatatctggacgaataggctttgcttgatctttacaatactgtgaagtaatggggaagctgactttcccatattacaaatatagaaactgaaagcctgaaagacaaggttgatgaatttagcaaaaagaaatacaagacaatcagttaactttgaatttcaataaaaaataaataccttcttagcaaaagtgtatcacaaatattgcatgaagcatacttacactaacaagttattcattgcttatttgaaattgacatttaattggacatcttttatcgtatctggcagccctacagaaaagtgacctaaggccatcagctacaatccgtctcctgaccagtttcactacgtggtgttattgcctgactttatggctcagtcatgtttagattccttccagagttctatttcagtttccttgtcaactcactgtaagcttcaattatgttctttaatgtctgagataaagagaaagctgcatttaggcaaaattattctagttgacatgcactattgtagaaatgcctactgtttcctattttcaaagtacttttcatcatattatctcattgatcacaataacccccaggggataaaatgaggagttattaatgttccactttttcaaatttaatgattaggtctcagagagtttaggagacctacctaggttctcacagctagcagggagagcctagcctgagggtcaagtcttccatgtaaaagttcaattaagtagaagtaacatatgtgctgttgccatttattgttaagataattaaaatactaaaagactatttttgacctctggtttaacatacagtaaacaggggtgagtccttctatattattttgcttctatcaaaatgatatgatcagagaagtatatatagtctccccaaaaattttttaatcatgtcatttcaacaaagctgtgtttttgtgttaaaaacacagtcttacaaaaacagaaacacaatcgcccacttttaaagttatgacattgtctcaatgtctttactaaatacttggttatattatatcattactgtcataaagagcaactcagtaacagattcactaaactaaaatccattcaagtgtattccctagcagtcaagtgggctattttaatgaccttcctgtaacaggtaaatgaattcagcctgttatttggtgagtcattttgcttgccaaactcttacttaaaacctaggtattgtgagtgggcacatggttgcttccacagctaatgttttggaaagactagtgcaggacttttcttggtcactttgccagccagagacctctggccagtgacacccctgcccaggccttgcttgggtccgggttcaccgcaggagacaccccatctactgtgcctgctggtcagcacccggcctgcactccagcgtggttcccacagccactgtgactgtgcacccagcctctggtgggagggggtgtgtgagcaagtgagtgcaggctccggtccgccattccaagtgctggcacagaagcgggctctatgtggggcttgtggttagaccaggcatgtcataagtgactctcatggtggactctggcacctcaaatgcggaaacgtggtggcacccaggcaggggtgcccctgaccctgaagcatgtgttacagcatgctaattagttctttaagtcccgccatctgcagcctaatggatggtggcaggttaacaactctgtcagtcccttgctccactctggcccacggctctggggctggctcagccctgccactgcttcctgatgtatggggcagctgtcctccaccagcggagggcagaggaccatagtgttacaactttctttgtacccacatttcatgggttcttgtcacacttccaagaagaatgaggttacgcagacaactgaagggtggggagagcagagaagaatcttattgagcaatgagaaagctcttagagcagaaggaatgtatgggtcatccctctacctgatgtcaggtggtctcttactcagtgtggttgagtctggggcttttatggactcagaacggggagttcatgttgattggtttgtaagtatgcaaaaaggctaaaacaaaggcacttctcaaaggtgggcatgacagtgtaaaaaaccaattaggaaagggtacgtatatgtaaaatagatgaagggtggggatcaatcagaggaaagcacatcaaacaagaagggaggttctcaatctggtctgaggatttacccaggacttatagctaggctttaaaccgtcttctgcttgaaagtaatgtttcactggaaacccgtcccatcttcatagatttttgtctgtctcctgcctctatcaagaccacatgaattctgctaaatatctaaatatgttttccaaaatgaagtgaacaaatgtcaacacatttgaaaatatatgattagcatcaaaaaattaaagccatcatccctcaattagcatttgaagttaaagaattacagaatatgttttattagtaatttttaaagttaactgctatttgttaaaagagccatttttgaaaagggttcataatacaacttatctttccatccatctcttgatccccatgttttctctcccattttgcatgcattctttccttcctctcctcttcttgtttttctcttgtaacccttttctctcttcctctatatcatcattttctctccgatactgggctcttgactgctcattatcatcctaattttcttttaattatcatttccctctttcccttacttatatatggaatattgttatgataaaggatatatgaaaagacttgaaagctacataatgctgtaagttactgacaaatatattcttatatttgtatattataggataggacatcagatatctatttcctatattttaaattatatcaggtcttctaatttataattgttttataagacctgatacaattttaaggtttattacatcaggtttattatgcgcatgagcagtgttgtctttttcctttatgttgtcttatataagtattatataatataatactcaaattttaagtcttctgataatagtatttaacatgttaataaactaacaagattatgtttagaaaggttctactaaagtgaacaatattccataaagggaaaattccactattataatgataaactatgtaatatattcccatcagataataatacaaatatttaattataactcattttttcaatatttaaatcaaacttggcttttcctagtgtgttggacttatgcggaaaaaaattattactgattttaccatctggcatctgcaaccctgcagaagttatatggtttttacctaatttgagtaccattcagtccattgatacccagatactttcattcattgctataatattacaatccaaacttatatattttctaatttttatttcacccttatttactgctgtgactttttatatgaataactcaatttgttaaacatgtttaggacacccaagtctcaagaagaattatgctgtttaaggtcatactgtagcaatttaaagccaaattacctagcacgtatcccataactcagatcatgtttgagaaagaaaacgcattttatgtttttcagcttgctctaaaaagtggagaaagtaaaaaacaccagtagacatttcacttaaagtgttttcaataggttttcaggatgtcctaggaattaatttttcattttgttatagaaattactatttctccttactctttttataatacatatttataaaaagatgttttcactttaacataaaatatattcatcttcattgagtatgtatgatcactgagatgcactcagaagtgatataacctgacacataagaaaaactctattttctttgtgatttcattttatttcttgtcctactcattttaacagatccacgtctactgattaaacacattaaacttttgttacaaatttcaatcaatttataaaaattcaattcaattctctaatgtgactcacagcttggtgcatgctgagcagttgggcctttatctcagagctgttttaagattgatggtaatttcctgttccaggtatatacctaaggatacctgctcatggtctcacagcagcatggcctgattccaggtaccaatagctccacaactgctccttaggtatttcagtttaaagtgactgtggtcaatccaaagccatgtaaagaggaatgttctttccttataaaagtagtgtgatatagtcatatttttcttacagtatcagggaagataacagagtattctccagaaacattgaggctggaacttgacaatgattgaatcactaagcacctacctggataatatcgagctaggccagtggcactgccaaaaacctgccacaataatgaagggtcttcctcgcgattctttttgaaaacttcatctaaggcacttgtccagttgagttcatttaacacaattgttgctaacaaaaaagagagaaaccattaattaattcaaatttgtaattaaaaactgaatgtcttcatttatttacaaaataatattaaatatgttcattgttctacctataaaataactctaatccagtagttatcaacaagttttcgacactttagaggacagtttgactggatctactaccaacatgtacatagtattcatcgaaagatgtttttcaagaggtttatactctggagagaatttctgaaaacaaaactttgtatgacagtgtccctactgacattttggcctcggttattctttgttgtgaggtctaatcctgtgaaaatgtttagcagcatctctggcctctatccactagatactagtacctccccacccccaagttgtgacatgcgaaaatgtctccagactgtcagatggcccctgcgggcaaaatcactcctgcttgagaactactgtgacacatagaatatgaggagaaatgagtggtattcctttttatcctcagaggtagttctgaggaaacctatggggcaccttaggacagagttttaagaccacagtaatcaactattgatgactctctgcggcagagcaacataaattagcctgctaccttaaaaaaaaaaaaaagaaaaaaagtcattgggcatagctaattaactatgtttatacaacaaaaatgtacatattttagtaatgggaaaatttactcagaggcttgacaatatccgtgttagaaacaaactagttgacactttatcactaccttcataaacaatagtttttttttttctcctggttatttctattaataattagagcatggtgccgataagggccaggtgattgattttgatacgtatttataactagaaactaatcttggataggtattacaaacatataccactcattacaatgaaagagaagcaattataatgtaggatataatatgggttaagtgtaagatataatatgggttaaaatagtgcataatttataactgacccttcatgatcataacttctcaagtctagcatactaaaaatttaattggcctaatataattttccctttacacaaaaaaaggcataattttctatgtaaaatatacaccatgtccccagagattagcagacagggccactttgcatttgacaatctctgaccaagcctgaacagtggaaatgtgcttaggataaagactggagatacagcttaacgtctttctatttttttctgtgatgacagcaaataaaagaaatgaatgccatcatggttaaatcatgcacaagcctttttaaaggtaaaattaaaaacagcgcctgtgaaacaagatgcacggcctatgtgtttatattttaaagttgtatcatttaccaaaaaagaaatcaacaaaaacaaggtgattgtgaaactcttctgggaccagcatgctaaagcagtcctcattattgaaaactaacaagattttcatctttatggatgcgattactttcaaaaagatcagttgtgtgtgtgtgaatattcatgagctgcatcagatccatcgtgcatctgagatactagagaattcatattcaaaagcatgatccaatgaacactaagcagccagttatatgagaatttatattcacacagataacctgaactgatacccactattcatgaatatttatatcaatatacaaaatagcatagaaagaggaacattgtgttttctcttaaacatttatgacttttatagtaacattctactaaacaaatgtttatttatgatccagatagacttcattaatccccaatctattctatctctttaatttccttgattctttcattcatattaggcaataacatctagttatttttaataaagttttatttgtttttaaggctgctaactttttcttagttttgtttgataactcaacagctactaagtattgggtactgacacactgattgtgaattatacttttataaactgagggaaaaagtcaagctctacaatattcctattatcctggcaatatgttttaagatttccagttgatgctttgaaaattttctttttcagacaagccattactaaggtagatttcaaaatatttctctcaaaatgtgttcatctacaaatgagcaaatcatataaagaattcccagactaggcactagaactgattttaaatttgactcagaatgaaagtattggcattgcacacctatcacatcagtacggtttataaatttgatatacccaatgtgtagtaagatgtaagaatacagacacttccatgtgttagtatatagttgcagggacttttaaatgcaaccattatcctattagtcacagtctttttatggatgtctagaaatcaaaattcaaagacgatctgccataggaatgcaaaattactacagcctttgtagagagcagtttgactggatctacctaacaacatgcacatcgtgttcactgaacaatgttcttcaagagatttatactacggagagaatatgtgtctccagttcttcctcagagtattatagagcaagaatcattcattcaattccttaaaataccaaaactagaaagtaggataaaactgcttcactaggaaagttttttctcaaataatattgaaagcagctaaaaaaaaaaaaaaaatggaaaagaaaatatataaagcatcaaagccaacaaggaagaatgaatactattttagaccttgggttatctgcctatatttttctgatccacattatgcattatatttgactaataaacctatattactctggtaccttgaaaagaccagactttttttcttcttaaccttataaaattaaatagctcatccaagattactaaagtgcccaacatttctccatttttatgctattagcacactcaggataaataatgctgaaataaaagggtaatctgtagatgatagataatataacactaaatgcacaataccggccatgctaaaacaagtttatgtcatttcctggatacgaattgtgctctgccatttccattgtatttatacacacattatctctctctctcttcccttgtctctatctctccccaggatgccccttagcccctatctctgtttctgtctgtctctctaaatatgtgggtagagtttatttaggaagttttttttgttttgttttgtttttttgtttttaactattctggttacaaccgggtaagtcaagtgctttttaaagttaaaagttgtttttcaggagatcttttgttttatattataaagagtttatgtggttatgctggtgcctttctctattcttagacagtatttttagtctctcctgttttcctgacactgtagttcttaaaaaataaaaggtacaaaacgtcattttttcataacaggaaaaataaaacaaggccaaattccttggaaaattattttcagcaaatattactctagattatgaaactgtatttttcattcatataaaacctaatctcaaaaaataattgtggaactctgatttactgaagttcaataaatatcaacaaaattcaacaaaaagtttcatttgtcattgtatatcacaaagactttaaaatgcaattattattttatgtcataatctttatttgaatgtcaaagattttatttaattgtggaaatatcaatgtaaattagtagccaaataatgtttaatataaaaattccagaataaattttctttacgaaaaaacttaaaatatttttgaccgtaaaaatcctttgatttggcaagatatatttaataatatgtataacaggtgaatggtattctataaattggtattatttaaaattatattgtattttatattctcaattatatattctatgatctttttggcacagggactggttttgttaaagacaatttttccacaaatggaggtgggacatggtttcaggatgactctgttccacctcagatcatcaggcattactagatatctcataaggagcatggaacctagatcacgcacatgtgccgttcacaacagggttcatgctcctatgagaatctaatgctgctgctcacctgacagaaggcagagctcaggaagtaatgctctcctgctgcgtggcccggttcctaacaggtcagggacccagaccggtccatggcccaggggctggggacctttgttctatatgatattatttattatatattgacagttgccctctttttcctccctacccctgacaaatagtaatgttttacattcacatatacttccagtttcttgcttcagatgagattagaagtacatgagtgttcaatattttttcactatagaagactgctcagtgacaatctagccttgaacctactaccagttgctgacaaatttagctaattgtcttagattaggagtaaaattagttctcattttctgtcaacttttaagaaatgaagatctttatccctgttagaaaattcgattttgtaaaaattaagtcttttatagatgtccaaggccaagcctactaaaagcagtgaatgcttggaaatcaaaccttgactttgaggcctttattctgaacggcataataggatttcactgataatcgattcagaaagccaagcatacatctctattctttgtttacttagttttaaaaaactggccttggtgtcagcaattctcccttttagagtattctattgttcagtctggattctcaagagaagaaagaaaaatctaatttgtaacagcacaaaagaaaccccttatatttgctgctaattcttctaaaagacacgactcttctatctatatcttgtttatgacaaggaatacagaatatttgacgagctctgaatccagtgttcttctgcaaacttcaaccaataaaatgttgcactattgctccctcttaagtttgaattaagtttgtattaagtttgaatacattttcttgatttattcagggtccaaggcctcaccatacattgatggcaccatatgactatttgaagaatcttactgttatttataatgtcaactacagcttttgtaacagctttgagatgtcattgacatataaaatagtataaagtatgaaatgtgatgttttgatacacctgtatgttgtaaagtaatcatcaaaatcaagttaattaacttatccatcacctttacataactaccattagggtggaagttgggggaattaatttaagatctatccctcctagaaaattacaatacaatattgttaactatcctcgccatgctgtatattagatctccagaagttactcatcttttaaaactgaatctttgtacccttacctatagctttctaataaagcagatttatgcaagaaaaaaagagaaaaacatttgttaggacttactgaaaatataaaataactctaataagtctttaagagatgtagctattaaagatatgtaagggactagatactaaaaattatttttgtttaacaataccaaatatcatacagttaaataagagaacaagcaaaaatgtttaccatttcatgtaatttataatactattctattacagccttgcattgagataaaaattagcatgttatttaaactattgttactaatagtttagtactattttatatttaagtactattttatatttaagacagtatatttaatactgtctttgtgacagtaaattttgtctatatttcattctacattttggcactctttgggttgggcaaattttcattttagttttggaaacttactattccttaaacaagcaagcaagggtttcaaatctagtttttaatgcccttaaatgttacctcctccacacctttaatttttggacaatcatagaatattagaaactttgtttagttttagattcaacacttattgtaagtatgattctaaacaaaagatatcttttgtggcaaacgttcatttcacaacatataaataaggtagtcatttatatgttgactaccttaagaaaagtcatttatatgttgactaccttaagaaaagagctgcattatcagataagctgagccagatgtcactaattttattcaccaaccctaatctctgaaaagaaagatgttaataagaagaaacctactgatctaattaagtgcacagggaaaaaaagaatccactttaaggagtagacagtgtgcataaatattaaaatgaatgaatcttttcagtggatttggctaatggaatctcatctaatcccagtgtaaatgaaagatgaataaggtacagggagatgggaagaccaaatctaatctctctaatcatgtctcgggcaccagaatccacctcgcactgaggatgggagagcagaaggctccaaggcacacaaggaccttgatgaggagataagccttattcctacagttaatttggtacaaatatgaaaaggcccttgtccttgtcagttgtctagcccctgtattactgagatttctggccttgccccctatcactttagtttcctgcggattgagcacctggccaatgcccagaacacagctgttctgctttaatgaaatctgcacgctgtggagcacagaggaggagctcagaagaaatccactttattattaaagaaaacaagggtaatgcaaggggaatagaagacactagtatctaatatcatgtctactaattgaatgatttaatgtcacttgaaataaaatgataattgtaagatttgaggagggagaagggctgtattttgtataagaaacctcagaaatataggagccccaaggtcaaattattgttttatcctttaagcattctaagcttttctctccttagtagtatcaaaaccaaataaattattaatgactttgatagcctagaatcacaatcactggcacaacatactacttaaaacaaatcatttaacttcttgtgcttctgttctattcgtctaaaaaaatgaatatagctatactaaggatcctagacagcctatagggttggtgtgaaggtcaaataaatttatgaatgagaactgaattagcaagcatatttttattccagttctttcctcagctagattaaaatactgtacggtgcacatctccctaagtgtcttacatagacaacaacttttgacctgtcagcatactgttttagtccagtcagtaatttcctcttccttgaacaaaaacacatttcttttacatagagcaattagaatgtaaatctgtttatgttgtgtaaagcaatattccttctgcttaatctcctaatttatttaaacactcacatcataagatattcttcattagaatcagctagttgaaaattttcatttcaaatttaggaacattatgtaatttgtaaaataaagtagaaactttagcataattatctgaagaaaatacaatatcttctattgatagtacttcacagtcattttttttttcttgagacagagtctcattctgtcgcccaggctggagtgcggtggcacaatctaggctcactgccaagctccgcctcccgggttcatgccattctcctgcctcagcctcccgagtaattgggactacgggcacccaccaccacgcccagctaactttttttttttttttttttttttttgtatttttagtagagacagggttttcaccatgttagctgggatggtctccatctcctcacctcatgatccacccacctcggcctcccaaagtgctgggattacaggtgtgagccaccatgcccggccacttcacagccatttttatgagaaattttagtatttgtaattaaatgagtaaataaattgttaaatttctattctatattttagagtaatatttcagtaaatacatagcctgctaaactctcggtaaatgaaaacaacaagaaataccctaaagatctttcatttagaccttaaaaagagaaataaaatgtgtgcgtttaaaaaaacatcagaaactctgagagcagagaaatgaagccggaagccatagaagaatgaatatgcaattaagaccaaatttaaaggactccaaattaaagtgtgtggtttttttttgttttgttttcatgcatactatagattttctttctggtgaggcctttttctaagtggtatttttaaaatgagcatgtgaatgtatgtaatgtgtgcaaaaactattctcacccattatccaccctctcacagactgcacgtctttctgtcagaagtaaccacttgatcttgggaaagtgttttaccctctctaaacctcagtttcctcactcgtacagtggggataataatagcatctgcatcacagggctagttttgaagattatacatacttagaatactacttgtcatttagtaactgcacaataagtgttacctgctctcatcattaatcatcattattttctctgtctcctaatactcagcatttaaaatatatttttaatttatcttgataaattctgatctgactcctaaaatccaagtatgagtgactaaaacctagtattttctttttcctcaaggaacttttgcccttcttaccccaaccccagtaatgtccaacaacactacttaattttcttgctatgaatctcatgaagaaaggttaatagtctattaacctttccatttcaattgctataagacaatggcaaactgaaaaaagatttttaatatcttatgtaacttggtgagaaaataatttttacaatggcatattccaagtgttccagaaagcaaaccacactgatgaatgctgcattgaatacagaatagtcgcactaagattctagtaaaagaaatgaaattatatcaggtctaataggcataacagacaccacccacacatacacaggcacacacacacaaaattatgcacatacaagctcctgttaatgctgagaagaaactctggctgagaaatacagaccaaattagataagggaaatctcttggctttgctgtgagactgcccaactgcataagaaatttagtgtctccatataaatctggactgctgaattcacaaagaaggatcaaaagtattagaagtgactaatgagatatggttgaagaaggataacaaggctcctggggacaagggtgatattgtcaatgaggcacacacagcttggtactcaagggtttgtgtcaaccagttttagagcaaagagttgcctggtgattttaagatggaaagatcagatccattgaagcacagtacatagaagtcggctataatcaagaacagtgacccgttggtttaaacatgtactgcttcagaatgaaaagaaaaaaaaaaactatatacatctcagaaattgaactacagattaataccgaatcataatatataaaggtatgaatgaactcaagcactatttctaagacaacatgaggttaatatccttgtatctctagttgcacatgtatagagattgtccacatatacatgtatgcatacatacatgcagaacattacatgttttacgtacacagagagatggacatctgtatacaaaaaaatcaatattgttagtattcaggatgcctacaacatagtgagcatgacttgtttagattttaatgtactcattagagttgacacattaaatttacaagtccttgctcgtgtattactcagcagatcttaatacagacaggaatctttttctcttccaataaatcatgtatttttaattttcattcacaactcaatatcccacaaaaccttagatttttcaaatagatttaaaaagctcaaattattctgacatgatcaaaacatgtacccataagacttttctaaatgacttaaaagttttccaatctgacaaaagataatagaggatggtaaacaaccaagtcatgtcggttctaatgccagtgtagctatcctcgtttctgctcctagccgtactcttgggtcttttgtgtaacctttaaataccctccctccctctaattccagctcacttccatccattcctcctactgctgccacaatattctacttggcaaatgtcttccctaattaaaagtatttgttggttctccataaaagctggtcttttatgactggcttccatccatccttctggtgtcctctcctactgctctttcaaacacaacaagcccaagccataacaagacttttgccattctcagaggatgcaaagtttactcctgcctcaaatgtcattctgtatgctgtcttctctgtctggactgagttttttcctatgcctacttgttaaacttctcccttcttttttattacagttcagcatcacctgctctacagggtgttcctcgattttccccacaccatctcccctcacccagcagagtatcaactccctccccactccttatttttttctatattcttctattaaaatacttcctacgtttcactatctttatgtgtgtgccttctattatactgggtagggtaggcaccacgttattttccctgatgcctagaatatagtgaaagaggcaatgggatgtgacaaacctgtgtttaatgcacagttgtaccaccttgagtaaactatacaattgcacagacttctagttttcaggaatgaggtggagaaaacattatgtacaatagctagggttgtgaaaattaaaatatgctatacttaacgtataacaggcacgccataaacagtaataactagtatgttttggtacatactaacaatatctatttgttaatgaatgaaagagtgtgtgaatatatgaactgtacctctctgttggatatttttaagttggaaataattttcatcatatctgaccaagtacaaatggtagaacatttccttttctttccttcaaccaacaatgataggcggtggatgggtatcatctgaatcagagagatttcatccattcaaatgtccatttaatcctgtttttagtttaacttcaagttctgtgataaaatcaccccttttaatggagatgttctgaagagcgtggtgtaaatactggcccaatttttagataagtcctttaagtcagtgaatatcactatgaagcttcttgttaagtatttcccaatgtatgtgcttcattttctaatcatctcatttctgtcagacattcatccaataaatatttactaaacacctattatgtgtctggaacctttctaagctcttgagcacgagaataggcacactttttcttaaagaaccaggcggtaaatgttttaggtctatggtccacatggtctctgtcacaactccctttacagcagtagcacaaaaacttccttagacaacacataaacaaatgggtgtggctgtgttcccataaaactgtatttataaaaacagacagtgggccatactttgcagactcctatacccgagctccagggcctatcaagacagacaggacttctaacactttactggaagagaaacacaataaacacataagtaagaacatcatgagtgctctttaaagaattaaatctggagatgccatagagattgactaggtggctaccgtaaatcaagttctcaggaatatcctctctgaagaactgtattttaaactgggattttaaagacaactagccatggaaatattaatataaagcatttcaataaaccagtagacacaatgatattgacaaataggaaatacctagatatcaacatgatggtatgatctagtatgatattgcaaggacaaactctcaatatcaaaatatcctgcaataacaaaacatccaaacagatacagatggcacaaaagagtattgtgacagattacagtttcaattttttactgtaattgatatatcctagaaagaaaaaggtctaactccagcatcatatttaatcatttttaaaaatcactatttaataattcttcataaggctcttaaaattcaatttcaaataagttgtgatcactatttttgaagatactttgagtctaattgagaagacacatagataaagcatctaaatcaaattttgctttgcataacagaccctatgagtaacacctgcctatcagaaactaagcaaaggttttgaggggcagggtagaagtagtggtcacaaaagattttctgaaagaggtgataagcagtattaaagaaagggcagagaggtagtagaaggaccgcatgcctgatccagtgaactcgctgtacaggcacacaggcagaaatagacatagggcattctgggagttgaacattgttcaaaacagctgaatggatgaggaatgtggggcaattgcagggatgttattagagagacatgattataataatctaggaatactaaagttaaaataattattctgagaattacagagggccataataagctgaagtatgaaataatcatatctgcaaaagccagccagatgtgaatagagaagagagaaagcaggtaccatcagactggtgaggagtaataccattctgaactaaaacagcggtggtggatatagagagtggaaagagattaaaaagatgttgagaaaaaatctacaggccacagtaacaaatgtgggaaaggagaaaacaggaagcatggttttctgacttgggttcttagtgttattaacaaagatatgaacattggaagagaggtacacttggggacaacagtgatacattcaattttgaacataacgtgaggtgcttctgagatatccattaaaccgcgttgtttaaaaaaggcaatcagagtagtcaatctgcatcttagccatgaagtgtataaggaagaatcagatttgggaatcatgtttcagtgacaattcaaaatattgcttgactaaaattatcactaaaatgacaccaataatgtctatgaatcctcaggtttaagaggcaagcaaggacaggtccagtagctcacgcctgtaatcccaacactttgggaggccgaggcaggcagatcacttgaggtcaggagttcaagaccagcctggccaacatggtgaaaccctgtctctactaaaaatacaaaaattactcgggcatggtggcatgcatctatagtcccagctacttgggaggctgaggcaggagaatgacttgaacccacgaggcagtggttgcagtgagccgaggttgcaatgagccgagattgcacaactgctctccagcctgggtgacagagcaagacttcgtctaaaaaataaaaaaaataaaaaaataaagcaagaaataggaatcagatagaagttgctaagaggaagcaatgtagacccaactctcacaaacaaaaacataatttcccattaaaaagtgatcagtgactggtacactttaacattgttttcatttaactaaaatggcaaaatgtgccttttgcattaaaataaatgtactgattataaattccatgtatctatataaaactcactctatcaagaagagataatatgaaggatgttgaaaccaatacaaacccattattttctaatgcattgttttatttgcctttttcaaaatcattattgatgtaaatcatgtacccagggatagaacgcctgcatatcttacatgtacagcactttgactaatgcttgctgtgcacttggagaataagcaatttccctgctgcctccattagaatgatgaggtaatctactgtgcctttacacttacagcaagcctcaagagactgaggcttgatgattacatggtcttataaggccataaagttctaccacaggagtcatatatgtattataaagatacttcaaattgctgacatagtctcctcaccatcaatgcgtgactcttctgcaattcacttgcacctctggctttctgaaatgatttaaaactgcatcagaactcaatgcatgcatgccaaacatcatcatcagaaggcaggtctgacaagatttaattacttagaaacttatcagatttttaatcctcaacaataaaactataaatgacttttcagtaagatgtaataccaaaatgcatatttctcaaaacacaaaattagacatgttaagaataaactcaatttaattttaaaccagtagttactctgatgtaaacattgatgttatactgaaatgaattttaccattcttcccaaaacgcatttgccttcatattaatcttactcatggttttaaaagaatcctttactttcttgtcagtttgcattctgtatcaaactgacggaagccaagatctttcacattatttgtcagtttcactgccctttccaaatatatctgtagcaaaaccttttcatttgtctgatccagttgaaaatcttttatattcattttactgagacatcagtcttcaatttttcccttccattcactattcctagatgtgacacttctaacaatttgtagttaaaattaaaagccagtacattttattactgtttaatatattctttctttttctatttttaaaattacatactctaaaacaggtagcaataccttctttttttttttttttttttttttttttttttttttttttttttttgagacggagtctcgctctgtcgcccaggctggagtgcagcggcgggatctcggctcactgcaagctccgcctcccgggttcacgccattctcctgcctcagcctcccaagtagctgggactacaggcgcccgccactacgcccggctaattttttgtatttttagtagagacagggtttcaccgtgttagccgggatggtctcgatctcctgacctcgtgatccgcccgcctcggcctcccaaagtgctgggattacaggcgtgagccaccgcgcccggccgcaataccttcttaaacaggaaggtaggagtgtgtgtgaatcactgtaggaatcagatcatattattctgttctctatgtaaactgatgtgtacttaatacatgtacaattaatgacatttacatcatttaaaaagtagttctacatggacacagggaggggaacaacacacactgaggcctgtcagggggtaggagaagggagagcattaggaataataggtaatgcatggtgggcttaataccaaggtgatgggttgcatgtttacctatgtaacaaacctgcacatcctgcacatgtaccctggaacttaaaaaaaataagaaaaatagatttcaaaggaaaaaaaaatttagttctgatacatctacacactgcaaaaaccttatataattttttgtgtgtgtgtgaggacagaaaaaagtgagtttttcaggcttttagagattccaaatgcaatgagattgaatttactgtttgtgttagtctcaaaggggcttttccttaatgcaaatttattttcttgattccaagggtatgccctgtgatcttttctacttcttgaaatgtcttattatttcatataaagttttttattttaaatcaaaaatcaaattttttatctagaattcacatcctttattaaaatataataaatcattcacaggtattattagtgtttttagagcataaagatgtgttcattaagatgaaaactttcctgaaacccctggatgttatttgttatgtccatttctaaacaacttccttctttcaatttgttcagaataagttgaaataaatgctatcaacgtcaaaatacagactatcaaagtgtacttattttctagcttaagaaacttttatctggaatttgaatcaatgcacagcttgctggaaagatttctatgcatgaaagatatacatatatgaagtgtatacacatgtgtatttatgccaagtaaaacagagatttagtagaagatttgaaatggtattctaaatatttcaattttgagaatgttacccacaaaggtatattttattttagaccaagattgatttcctgaactttttaactttttttttttttctggcaaatgctgtaatgctattttctaagtagagcttagaaatgtttaattgtacaaatttttgaaatgtacaaatcatagtaagaccataattttgtggataaactctttgaaatataatggaattagaatatttggcaatatttcatgctgaaatctagaacttactatttataccaaacacaaatatagatacagatctgccaaatgtgtaaatgtcatattcctttgtagacttttatcctggaggattcttatttatataagatattatataagtagattaaatttgtagtcaccacacactaacataaaatgaaaatctaaagaagaaaacaattctgcacaagtaccaactgtatattaccaacagaatttgaagtttggaaccaagtgggtgggtattggttagaacagacttctcaacattcctgtaccaaagtctccaatattatcattaatattacaatatagcagaaggtctacatttggcatggccaaagtcttgggggagcacacaggtgatgatgggtgacaaatgccttctacattatttacctagaaattcaacaaatgaaagtcagtaaaacgttacatgacagatggaagtaataagacaaatgaaaatctaaaagttccaaagtaaaatttccaatatattttaaagtatactttattgataaattgaaaatcaacaaggcacataatagtcatacttagtccattgataacctctaatttattttcggtttccatttaggttttatcctttgtgatcttaatgaaaaatatttcaattaaggtgagtatagcaatgctatagttgcagtaatggtattagaatatgatacatagtttcccataatgcaaaaatgtcttattttattgatagtttaaatatgcttctttccgttttttaccgcaatctaccaattcaggttaaattcaatctcttaatttgattttggcctctaacctatgattatatagtacatgttagttcaattatttttgtcataaattaagtggtgtaactgtatcagtaggaaaggttaacatcacatactgtgggtcacagattttgaattttatataataaattggagatattatttcagcatataagatttatgtattcaggtaatatattgatctgtggacatggaaaggaacaaaaatgtagacttaaactatcaagagcctaaaatcaatttctcctccaacctcctaagagagtaagctgtgggtttttgttttccctaacctgccattgttttaaaatcgggactaaagagaaaaaggatagaagattgaaaataagagaagggaagtaacagttctattgtgcagctcctgaaaatctgattgagaaaggttttaagacttgaaaaaaataagctttaaaatttattttagagataaaacttttagataaaaattttgattttgaaacatcttggggaaaaaaaatcctgagaagcagaggaagccagatttaaatcaattcattagtaattttataaatagaaggatgacacaaagataagtaaatgaataatatttcaggaagatttaagtggaaataccatatttgttgtgtgtatttgagatatatatatacacatgcatatatacatatatatacacacacacacacgcacacacacatatataatttaagtaggtaaaaacatcaaagtagttggtttgttgctgtttttcactcatcctacaacccactgcttgctgctggtggaattcaggtgtggaaagtggggcagtctgcagtatgttttcattcaacgaaggaacttagactgatggagattccatctacaaggtcatggggcagaaagagagttccagagggccctgtgctggcaattaaatccaccagcttgaaagtcatacatgtcacttccacctataaccaatggaaaaatgtcaaccacatattaccaccctgctgcaggttagaaagggtgcataatcctatgtgttgaaaggagagattcagattcctttgagcaatgaagtatctactaagccttgtcacagcacaaaacactaagatgtattcatgaaatgattatttttaacttcattacagacataacctatatactagaaaatccgtgacttttaataattatttatgtggataaacaaaagaggaacaacttggccaggcgcttgggctcatgctggtaatcccagcactttgggaggctaaggcaggcggatcacttgagggcacgagttcgagaccagcctggccaacatggtgaaaccccatctctactaaaaatacaaaaattagctgggcatggtggcaggcgcctgtaatcccagctactcaggaggctgagagaagagaatcgcgtgaaccaggaggtggaggttgcagtgagctactgcactccagcctgggtgacagaaccagactccattttaaaaaataaggaataatctaacaaaaaaacagaaagtctggaatgtgtttagaattacccatgttgttctaaatgaagcaaaaggtctattttaattaagagaggagaaaagattatgtgttgaaagtcttgaaaggcagagaaaggaatattataacactgtggttatggcatttttttacatagagtcctaatggctacttttgtacataattcttaatgtcgagttttaccgaagtactataatactcaacaagacacatgattaccagttactcaaatttacattttatgttaattttttattatttgtacaagttaatgccagttataaaattagatgcttgccaaataaacatttgtgtgtgtatatacatattcagattttgatagaatgcataaaaatagaagtcaattttaatcttagcacatcctttctgagaaaactaaaaacagtatatttaatgctctatgagtaaaatatatttaactccccaacccgaatatgtatagttaattctactgatccataagaactggctttattgtggcctaatgatagtttttattattgtattttcataaacttaactgaactttatttaaaagattataaacaaaaaatatactttattacacacagagggaggctgcatattcataacttgaaggccatcaaagtgaataatttcatattcaaattttcaggttttgtctattcattaaaatataaaccatctcaaaatcagctactaaaagttttattcacaagctatttagaatactgtaatatttgtgctaaaagaaccatgaaaagaatctaattaattaaattaatttgcatttgagcaaatttaattaattgtataattcatcacgttttccgttattttaatactgacttttttaatttaatgaataaatgaatgaaaagaggatgtttatatgtacacagttccatgttcaagaacttgtattaacagtagatgacaacattctcattagacagactaaacaaaatgatttatacttgttttcttatgaaaatgaagcatactgataaataaaattagactgattttggtttaaccatcatctaagagtgatctagtcacctcatacatgttttcttttaatccacattacagtcctttgaggtattattataaatattatattcttatgaaagacaattttgtcatactatttttacttaaggactgtttattcaaatgttcactgaatatcaccgttttccttttatagtttaaaaattttatttcttaccccttatttttggaaccattccacttatgtttaaaaaggctatccagttcacactatattacttcttccctgacttttccacttttaaaagcctttgaggaatcttcaaaagcaacccacaacatcctttaaaaaataagtatgagacaatcaactaatagagtaaatatgaactcctatgtgaaaattttaacagtacgatacgatttaagaatacatgttgtaattgaagtgatgtgactacaatatatcaatagtattcttcattaaaatgattatatataacacttgcatggtcttttaaaattatagatgactgcctttcaattataccatctagacattagagggaagattctatttctcaaatattcttggaaatccttattttgaattatacttgaaattgatgacaaatattttggacccttcaggaattatcttatttttcaaacagctataactcctctagaattaagtccgatgaaaaacactgtcttattctttttaaaatatggtaattattttccctagactaaaaaactgttactgaaggtaatttcaaaagagaattgtaaggttaaaataccagaaatagcatatatgcaaaattattgtgtcaatcttattctcatttaaaatactaagagaaaatgattttatataatttaaaacttggttaatttgagaatacacaaactgttaataatgaatgacaaatacagaggataatcaattttatccatttacccttctatcacaaatgagaaaatgttggttatatatcctagaaaattaatcaaaccagtttttgtcttttttttttttttttttttttttagctttgaggtggagctgaaaatttatgacggtcacaaattaaattattctggaattaatgattttctcctccaggtcaaaaaattcctctgacttataaaaggtgtagattaaatagaggagccattttgagtataaataatactatctccatataaaatttgtttctttcaaatatgaagccttccaccaacggcctgtatgactcatctggggacttctgctctatactcaaagtggcttagtcactgccaatgtatttccatatgagggacgatgattactaaggaaatatagaaacaacaactgatcttcacagacttggaagtgtagtaatggcacacttcttcaatcacatggcaatctaggtgaatacaagataataactggccccagtgtccatgacgcctacatgaacatccacacatgttccagtgactgtcatttgaaagaagcaagcaaaaacagagccacctttttagaagactgaaacaatattagcatggcctttagtactattttatgatactctataactcaggtagtatttttttaaaataacattattcattaaactaaaatttacatataacttcatttgatctaatgacaaatgttgactaaatccaatctgaatgtttgcatatctcataacccggtatctttaaagtctgatcttcgaattttgagacaaaataaacatgaaatctttatagtccatttaaaatctttgtcgttttaataaaattttagaaatatcttttaaatgcctttctacctctagggagaaatcgagtaagattttatccacgaagtcaaatgccaaatgattaaaaaatcctcatctcaaattccagacccccatttttttttccagttgtcaatccctttttaatttgctgtgaacagtactgtcagcctgttttggaagctattttaatttaagattatctctcttcttcaacctttgaatggcctgtcatttgttatacgcatcataaaagctagccaagtgcacttctgatttccagctgtcaatttatagaggcactgaattttgcacacattctttttcatgtcttccctctgggtttccttttaattttttttttaaacagtaaatttttatttgtattccctactaaacagtaagaaaaaataaagcaataactggattttttgcaaatccctgaatattcttattccataatagactaaaaaaaatcacaatattttctttaaacattgtgcctaggtaattgtgaaaaccaaatggaaatgaagaaaatctagtattgtaaaatacttgagctccttcttaagaaaaggcactgagaaatatcagctctgagaagtacttgtggaaaaatatatgatatgatattcctttctgacttatgtgcacacactagacagtgtgctaggatttatgtgatctgcatgtgggcattgttctcctaattagatagaaaacatgggttcaataccaagattaaccatatatgctgacatagattcttaaaaacttgaagtactcttaactcactgaatgtcctccatgaggctttcctaagaacagcagaatttcctttggctgtttcttatatatttggccaaatatataacatgagataaatttgtaatgaaatatagtacaagagatacagagtaaaacattaaaaactatccaacattttatgccttgattttggcagacttagtagtgtctactaaggctggcatgaagcatgtaagattcaatcattctcctgtagtaccctaggtagttctggggagcaaatccaaaatgctcccagggccatggaaggaatggacaggaagttttcacatacaacagagatgtgtgttgcctgggtcaaaggaaccagaaaaaaacagaaatccaaaacaaagagtcagcataaactagctacaaggcccgccatctacccagccctgccctaagttatccagacaggtaacgactaaccatccttgttcttcccttcctctctctgcttctccctagtttgggcaaaattcaaagagcagctatcaaagcccagcctccactgaaggcttccattagctcttcactaaggtagggaagaggagttaacactaacacaaatttggaaatttcactattacaatgaaaataaactttttttttttttttttgagacagtctcgctctgtcacccaggctggaatgcagtggcacaatctcagctcactgcaacctccacctcccaggttcaagccattctcctgcctcagcctcccgagtagctgggattacaagcacacatcaccacacctggctaagttttgtatttttagtagaggcagggtttcaccatgttggccaggctggtctcgaactcctgacctcagatgatccgcccgcctctgcctcccaaagtgcggggattatagacattagcgtccgcgcccagccggaatttcttaattgagacatttttattgagattgtttttatgtctaaaggtaatctagatcattttgttattttgaatctccaggaaagtcatccttatccagggtcactcactgaaaaggtttaataggctatcaaaataaagttggattttcacaacaaaccacgtcacatttgtacaaagtgattcatacagaaagcaaagtgagttataaatggtatcaaatttagaatatgcccatttcttaatatacagctatctgaaaaagtgattatgtgaattaactgaaacatacttgtgagaggtaaatgttacatagtcacatacatatatgaaaaatattgggtaaaacaaattttatttattcctagcagaatttctttgaccttttaagggttagtgtgtactatgaacctccaaagaagtagctataaagtatagctacttacagatatcctcatatctgcatgtactcaatgaaagagaaggattcctcttcatcgtagaaggccaccaaccctttcagattgaggcccgcttttgtgacctcatttaatcctaattacttcttaaagtccctacctccaagtatcacatcacattggaggttagagcttcaacatataaattggggatggagggaacacaattcagtctaaagcaatttacaatatctataaagctattactaattggtctgctgttctgtgatctgaaatgaattaaaaaaccactatctatatgataagaatactgtatctttggcatttgggttgataagtagtcaatattctcttatcagaaagtcaatagtatattgttctctatgaatatgcatgtattacataaatgttattttaaaaagatagtgaaagtaaaggccatctttacctcagaagtagaattgtttctctttgtgccaaacttattaattatggtcaaattagcctagcttaaaatttatattctctaactcaggcttgtcctcaatgtcttatgatgttcttaccatttccctgctcgcacctaatgagaaacaatgttaattatgtaagctaatcactttattacaatagacaatcactttgttacagaagcaattgtactttttaaaaagtgccctttcttagcacttaatcagatttctggttgcatgagtcagaatcaagactttataatttaaatagctctttaaaagaaaaaaggaaaagctactctgctaatatcagaaccatgacaacattttactgaaagttctttaaaaacattcacttttttagtcatttaacatacaactctatatattatatataatgatgtactttccagaattaaagaacccttttttttgcaaattatctggttttaaaaaatcaataaacacaaaacttaagaaggtcctactgatgaaaactcttttatgattctattgtgatccagattcacacttgtgacaaataccaagcatagaaaacaattaccctgaaaaataccagtgggttggaagtgtagtggatttttcagctcttcatctgagcactagatatgttaggaaatttgtcacggtgaggatattcatatatggcagctcatgtaagtcatgtcctgttagactaatcagcaattttaacaagaatgagtcagcatcctgtaaaatttagaacaattggttgaaagcctgttttgatttctaccatggtaacaatgaaactatcaaataaaaaaatattttttggaattatttgactgttgttcatgaaacaagtttggtatggtttagattggaggaacatggtaatattttgagttagtgagaaaaattgttctgttttattcatcttaactttgctatttggggatttaaaaataggaagacagaagcatttcctattagatagattccttgcattacttactgcatgcaatcctcactgcaccctaacaaggtatattcacctcctttgattgtaaagaagttgaatatgtaattcagcaataaagccaggacttgcatccacttctgttaggttctatattcttgtccatgatccatagctaaaccctgatgaagtgaatgacgtcgttttttaccccaggattgtacatgtttaaaattctagcgtttggaggctcagatttttttgtataaatgtgttatttcagcctacctgtccatcatacctcctgttcttataccttttatgcctattcttatcaacatagtatccaatgtccacaactttttcataaagatggaaaagattacaaaattcttcctccagaaaacatcccgcagctttccatttatgttatggattggatgtttgtatactcccaaaattcatatgttgaagccctaaccaccaatgtgatattatcaggagatggggcttttaggaggtaatttccatgaggtcatgagtgtggagcacctacaataggattagtggcctcatgagaaaagagcttgctcgctctctctgctagtgcagaagaggtcatgtgaggacacactgagaagacccaggaagaaaattcttactgggcaccaacctgcacctcgatcttggacttcctagcctccaaaactgtaagaaatacacgtctgttattttagcctatctgtctgagataattaagacaatctcaaagtaaatatcagagtctttgcaatcgtccatagggctgtggctgacatggcgtctgctgctacccctgctccccgttcgcttgctaactctgctctggccacaatggtctccctgctgattatgagcccaccatgctcctgcctgaagatctttgagttttctgtttccatggccacagccttcttacacaggtgatttttatggctcacttgctcacaaactacagacttcaattacaaaattgccttagccacaaggccttctctatctacccattataaaatttcactcttctctcttaacccaggcactatcattaacctcttctctatttttatcgagagcactcattacactacgatatacactattattttaattgtttgttttacactccactcccctccaatagaatgcaggctccatgagtacagagaattttgaccatttagtcagtgctatattcccattatctggaaaagtacatgacatactaggtccttaataagtatttgctaaatgaagaaatgtgttaaaggcaaaataaagagaacatttaatatttttcattcctatgatatatattttaacatacatatatatttgaagttagttttaattaataaaatttcacttgatgattgactgcttctgaggtaattaaatggtaataccatgtctaaaaaagctattttcctagttatgatgaacttttccttgatatatatatatacacacacatatatatatgtctgggtatatatatatatatatatatacgtgtatatacgcatacacgtatatatattcatatatatgtgtatatatgtatatatatattcatatatgtgtatatatgtatatatatattcatatatgtgtatatatgtgtgtatatatatatatatatttttttttttttttttttttgagacagggtctcactctgtcacccagactggagtgcagtggcacaatcataactcactgaaacctctgcctcctgggctcacatgaacctccaacctctgccttccaaggagctgggactataggcgcatgccagcacccaaggctgtttttaaaatttgtttagagagacagagtttcactatgttgcccaggccagtccctaactcctgggctcaatcgatccgcccactttggtctcccaaagtgctgggattacaggcatgagccaccacaccaggaggagctttctattccaataaaagatagtaacagtttttatcaaggtataattacaaaatagatatttttcttaacacatataaatataatccatattattttgttattgaaatcacagaacaaatgtgatttactttctaacatattgttttttaaactaatccatcaataaatcaaaatatttgttaaataaaatatgccaaatacaggtcaaaatattgtacacttccaagttaactaatatatatcaactactataatcaatatagtttgaaagaagataatatttcagaaacaaaatcattataagaaaaaataaatattaactctatagtttctgcctaatatcatttttcattaacttttaaaaaatccactttggttataaaccaattacatcctaagtaatctaccctacacatattaatcattgtaagtaacatcaaataatcatatatctctcgtggattgcatttcctttaaatcatctgttatccaaagaataatttcactctttaatttcagtattttaaagttgctctcacgtcttctcattatttcaaagctaattacaaagaataacattatacaccagaactgaatggtctaccaaaaccatgaacaagtttcccctcttacaaaatatatttgatgacgcagtatgacaagctagtatcactccactgaagtattttcactgagactataattttctcaaaaatatgcagatacagactttagagcacaactattccatctgaatcaagccttttgcccaagaacaccaaacaccttaaagaagcattgttttcctctgccttttatacaactatcagatctatggatttagcctgatttatgtacagcatgccagtcaacttgaatactaacttttttactctgttaaaggtatactacccacactggttcttggagtaacaacaaaatgggctgtttacaacagctaaatgtaaactattagcaagtggtggaccttgttggaacagattagttactaaaatttacaggagattatgcaattgtccagaaagactgcaagcacctttttcctctgcaattttgacactgatgtcatctaagatacagcggctatatcttttaagataacacaattgaatatcaagataagttacaaggataatgtcagtgattattagcttaaattacaaaaatcaagcacttttagtaaagcatatgagacatcaaaagataatacaactcatgaaaattgtcttcttttatcaaaatgaagatatcttcatgataaaagtatgttaggtatttttacttctaaaacgtaaataataattgccttacttaaattatagggtaagtataaggacaaaagtatctggtccctgaaagctttatgcaagttggggtttcttcctattattttccctcattaatgttattcttatagaaatataattatacaaagaactatcaatacaaatttccatttaaaataattatacaatattctatgaagacagccctacattgagtctaaagtgattcaaaaattaataaagttctgagattaaaaacaaattaactcagaatattcagcccttgtttttactaagttatatgcttgtcttgtataattctaagcagataaattagatctgaaaattaagtatggtttgggtgtcctctaaaagaaaaggagcaaccagtgaaattctcaaaaatggagattttgagatggggctctaattaaatacagtactctaaaactttaaatatatcattgagcagaaataatcacatttcaattcaagggactttaaaaagtaatcatctttgtgaaattagaacacgaggtttcttatgagagtgtagctacacaactgtcttaaaatgaaaaaggctgtttccttcagttaagccttcaattaaagtgcattttcatattcattaaactcagaagccgagaacaatcctctaaatcggatatgttcccacacaccacatgaagaatactggtaattattaaattttccagatcttgtggacatttctgatttcattcctgtcatttattcatgcagcttataacattggacatgaattttaaaggagtacaggccaggaaaggttagagtcttactgatgagatttcagcaaagatgaagatgccaatattaagatgaatgggactaaataaataatccaaagacagagcttcttttaattatgacatatcccaaagaatgcctatgacttctgaaaacatattaaatattttattgattctcaaaatgttaagttgtattctctgagactattaaaattatctgtagctatttacaaatagtttattttaaattggaaagaaaaacattgtttacacaaattaatttgtgtatgtaaattgtagcatactaagatatatgtatgcctatgtaaacatttttaaaaaaattttttaaaaatttacgttcaaatttgtgagtcagatttcatatttgttctagcatacaacagatggatgcttaagttataaagtgatttcaactcagtaaaggaagcaaaagagtaagagaatgcagattctaatgcaaagtaagtatcttactgcctcctgtggacaattctggctcacatataaccaaacaataacctataaacttgtccagacaatctgtcttgactaccaatactagacagagaacattaaagtaaagagggccggcgtgggggctcacgcctttaatcccagcactttaggaggccaaggcgggtggatcacgaggtcaggagtttgagatcagcctggccaacatggtgaaaccctgtctctactaaatacaaaaaaacaaacaaaaaaaattagccgggcatggtggtgcatgcctgtaatcctagctactcaggaggctgaagcaggataattgcttgaagctgggaggcagaggttgcagtgagctgagattgtaccactacacttcagcctgggcaagggagtgagactccgtcccagaagaaaaaaaaaaaaaaaaaaagaaacagaagaaaaggaagtaaagagaaagcagctagtgttctggccacaccacatttatttcaggcacactggttttggctttaacttcttttacacatcagtcttctacgtaaatacatgttgtaaacaaaatgttcatagagcaaagctattagaaaatcactgacttaaaatatcttgtggacatttataaattactaaatttagaaataaaaagcctcccagatatcaacaatacaaaacccaatcataaaagatttctaataaatgaacaacattcaagttggcttcagttttcttcaacagagtaacgcaggttgaaaagcagtgccatgatgtacagagtactgacaaaaaatattttgactcaaagcttctatacccagccagtttttcttccaattggaattcaatagaaagatacagaaggagattattattttgttaacatatccaacaaacaacaggtgatagatctgaaactaaagtggaaaatatattattcaaaaattgagaaacataaccatatagcttagcattgtctgaacagttagaataatgacaaaaacaattacaaatatcaaaagtaactacagaaaaataatacaatggtcaaagaaaaaatattaatatatgaatccaaatctcaagtgattttaaaaagggcttggaattaatagtctcagttgtattgtaaagaagttaaattatgtttaaggctcatgtaaaaagaaactatatctatacacacacacacatatatatacacatacaacgtttctattattatatgtaattataggtttaaaatcaaagaattgataggatgaaaacagtggtacttttaaaacacttaaaaggagaaacaaaataaaataatttgatcaaagataaaatttataataaaaagaatcatatatgcattaaaaattgtttttaaaaccaataatctcaaagtgaataaaaaaaaaaagctcatatacaatgtgagtcccttaatcttgtgagtctaaataaactttaactgtaaataataacaacaacaaacacttacatagcacttactatgagcctggcactattatgagaatttaaatacattaaacttgctttatcctcaaaggacatttcaggatactaatcttatctccattttacagatgagaaaatgcctactcagaaatttgaaggatttgccagaggaaataatactgctaaaatttaaatttggacacaggtagtctggttccagaacccaggccatctggataatctggattccaaatacactctaccgcgtctcaattaagaggaatacaagaaacacgttctttacaatcgcaagcagttctttccccttaccctttactatgtgagaaggcagggaacgaggtgcaggatggggtggagggatgggttaaagaataaataatatggaagaccagggatatgactgaacaaataccctgtttctggtcacagttcattctcagacatgatagagctgtcttttggaaaattcctagttagaattctcaggctctgctctgattaatgcaaagcgtgtctctaaaaaacaacacctgcgcaagcttccgccactattttcctaaacactttttttaccccatccctttttcacagggaagccttctccaaccaatatttccagtcacagcttttctagtttttaaggtctcttccttttacccaagcacttcttttggctggaagcccacaatacattgagaggaaggtactctttacctatatcctagggtaaggcagaaaaacacagaccgggagggaaaaagagagagagactgacagacatgagaagtcataagaactggaaagaatctgaaacatacaattttctccctttacccatttatgcaagaatatttttgcatgtgtgtataatacagctgcacagttttggcttttgacaaatatatctatatactttgtaagttatgggtggcaactgggaaagcagaattatttaccaaacattaagttagaaggaccactccatggatgcaggctgtcctacaaatattcgtttagtgagggtatactcacataaactgttcatgaaaatcagattgattctttcacataaatcagagtttaccacagactcttatatgacaaacaaaacaatgtcacatttgctcttttttttccccctcaaacatgggaaacataagacaggcgagagcatggtattccaacagatgttaacattcttttacttacagccctcatagatgtcagtaggaatatggactgctgcgtgctgataagatatttgtcgtccaaaattagcatcttcaatgaaaacaggttttatcctctggctgcctggctcactgtcatttttctcaggctatatagaaaaagaataaacagaatattacaatttttgctaacataaatattttcacatgcacttctttacttgccaaatgcatatttttcaaaaaataaatctacaacaattgtttaaaatatagtaccttgatagcattggatacacaaatttccattcaggtattagcactcacagtatatctttattgtattattcacattataactaaccactctcctgatttcctcaatgttggagtcattcaggatcatctttgggggacgagggagaccagacttccacacatataatacttattaagatgtaaacttaaagaattggataggccaggcccagtggctcacgcctgtaatcccagcactttgggaggaagaggggggcagatcacttgagcccaggagttctagactagcccaggcaacacggcaaacccttgtctctatgacaaataacagaaaattagctggacatggcagcacaggcctgtagtcacaggaggctttaggtcaaaagatcgcttgtgcatgggaggttaaggctgcagtgagccatgatcacatcaccacactctagcctgggcaacaaagtgagaccctgcctcaaataaataaacaaacaaacaaacagacaaataaaataataagaaactagagaggtgcctttaaatacaacctaactaatattatccacttgaaataaatttcacaatttatttaactaaatttatattgtgcagttgaagatgattctttgacaaataatggtacacgtgacagaaataatatggcaatgaaggattatttaaatctcatcctcttgctttttgcatgtttttcaggtatatcaatttttgttttaaaaaagaaagtatgctaggaaagaagcgatctattctaactctaaatacaattaaatcctaatttcaaccaatttgactcttgaggcaggaatgaagatccaatcaataatgattcaagaaaacccctcaggagtctcaagtcaaagattaattttctatctattggaactatacttttgatactgaattacctggttgccttcccctggtaacaaactaagaatttcattcatttatccaaaatgcatctataacattttttgatatttgtgttaaactttttttgttcagtcaaaacaggttttaactctaccctaactgtatttgtttttaaatgatatgaagtttaaaaattacgagttaagtaaaagtgaaaagagaaaaaatcctatttgttttgggtagaaacaggtagagggagaaatgaatggatgtatacatagcaagtgttaccagtattattcctggctttgcaattttaagaaataacttgtgctttctggtttttccaataatacaatgagaatatattatatttgtgataagaataaactattaaggtttaagtcttttctattaatattataaagcttgtcttacataaaaattacttctgtttcctctgaatcctctcacacttaacaattagcagttttaaattcatcttatggaggctcttgctcttttaaataaccatataaatggcttttagaaataactttaaaataataacgtacttctcaacttgtaaaatcatgtatcaagactccttaaggtacaattgttaaacatattttaaaaaagaataatagtgctatttccatggttctccttttctagtttatataaattaaaataacttcataaaaagatgagaatttctcaattgaactcatttattatctttaagctactggaaactactgttccttataccatcatactccatgtctttacttatctttatatattatggcagtatatttttaattgaaatacagtaaatattatatacaaaggacctgacttttatgaaaaaggctacttaacacagaatgtctcatgtagtaattaactatttcaaataaattctccctctgaaacaaagaattccagttcttcagaacacatacaagaaagaacatctatgtctccttccagtgttttcttttcaaaatatatcttctgaagtctacagaccaccatatacaaatgtgtacagagaaaatgagcaagtggattctgaaatatattcaaatgcatttgataaaacgaaactgacacatgaaatgcataattctcagactattcttctcaatataatttcagctattaaataatagattagatcactcagagacagagatacaagctaatgttggatgaggaggtcattcaattttacaaccagtgcatattagcaaatttaatttggaaagtcataatgataattctttgacaggtacaaaaagctcttgcaaatttaacatatttgtctcacccttagaactgatatttataaaaagcattgatttttaatattttgttctttttcatgttaacttaaaaaatattcctacttatagcaaaatattcaaaaattaaagtctatatattttacctaaattgcaatggaaatttacttaactattttgcacaattcagatttgcaaactgataaactttgcttgcaatcatactatggctacgtttatgtccccagttctgtattatttttgtgtgccacaaagttgtaaaataattagttgatatagaataaaatggctcactaaaactctctatggaagtatcacaatttgtatttctatctcactagtaaaggagttagatcaacagtcttggctaggtccagtggctcatgcctgtaatcccagcactttgggaggcccaggctggacaatcacttcaggccaggagttcaagaacatcctggacaacatagtgaggccctcatctctacaaaaaatttaaaaatgagcctggcatcgtggtatgttcctattatttccagctattcaggaggctgagacatgagggccttgagcccaggagtttgaggctgcaatgagctataattatgctactccactctagcctgggtgacagaatgagactgtgcacgcacgcacgtgtgtctgtgtgtgtgtgtgcatgtgtgtaggatcctgtgtgatgaaacaagccttgcatgcaattctccaatatgtatgtatgtacgtatattttcaaatttcaatctctaaatacatcctggttttttgtagtttttgtacagttgttatttacattagggcttgcagcttttacaatacagatattactgattttagaattttttaaagtctcgattactatcctcaatatcaattttggatatgtaatatgccttaaggcatggcatcacggtccaatgtaaagcattatcaaagataggatgtgttatatttaaggtggactttcatacaggcatcaagtctgaatattctggcatactgggatactggatcaacactatggattaaaaagtaaagtttaggccaggcatggtggctcacacttgtaattctggcactttgggaggccaaggcaggtggatcacgaggtcaggagtttgagaccagcctggtcaacatggtgaaaacctgtctgtactaataatacaaaaattagccgagtgtggtggcacatgcctgtagtcccagctactcgggaggctgaggcaggagaatcacttgaacctgggaggcagaggttgcagtgaaccaagattgcaccactgcactccagtctgggtgacagagcgagactctatctcaaaaaaaaaaaaaaaaaagaatgtttaaacattactttaaacattactttttaatatacagtattacattactctgttatggctagttcagcattggaatttaagcatcctgtgctgctctgctaattaaagattgttaccaggtctgactcacacagaggaaaagccttgtgattttttgtttgtttgtttgttttgttttgaatcaggatcttgctctcttccccagcctggagtacagtggcacaatcatggctcactacacccttgagttgccaacctcctacctacctcagcctccagagctgctgggactacaggtgcattccatcatacccacctaggttttttaatttctattgttcagagccagtgtcttgctatgctgtccaggctggtctcaaactcctggcctcaaataatcctcctgcctcagcctcctgagttgctgagattacaggtgtgagccaccacgcccatcttgaaaagcttcatttttggtaaatctcttggatcaatgagaatgaagactcaacagaattgcaggtgatgatgcccaaataaagaatgaatagaaagaggtgtggaactttcatccagtcagttgttctaagtcaagttggaaggccaggttgaatattaaatgatgaatctagtacaatgacaataagaacataactgagccttctgatttcattgatttaagctgctattttctcctatgacttagagaagtatttggtagatgaatagatttagaaagtgtatgagttggatgacactgaatatgcacttaaggacttacacataatatttgtacttttactgaatcataacaaaaaataaaattttgaaattatgtatttaatgaatagaaatattgttcttgcaaaaaaacatatgagcttaggtaatatatttgatgaagaacaaattattttatggattcagaagattatgcccattcttcaggtaataaaaatattgtaactccttagatttactctggaaaaactgtagcattgattcttcagaagcaatttatttaacatactaagaaaagaaagttttaaaattaacatgaaaagtaaatttataacatcagtggcgaaagaaaggtgaagaaacaattctagtttttaaagattagattcagtgtaaagtcttcatgtattattctactaataattatgatgtataaaagagaagaaacagtctgagatatgtagattttggggaaaagtgaaatcacaaagcagctgaaattgagcagtaacaaaaagaaagttaaaaaacactgtagggaatattaaaacaaagaatatataaattttccaaatgacagtgaaagataaattagaactaaattaagttaaaatgcaatactgatccctgcaataacttgtttattaaatttaaaagacaaaattgacattcttcaaataagattaaagtcgctgatgaggattataatgatgcattcaaaagatctgaaatacagaacctgaggacatccttgaaataaaactgatgtaattttagtttgcatgatgaataaatttagtttgcatgaatgcccatgaattgcctatcacaagacctagcagggagtaaggcgagccattagcaatacaatacagttgagtatgatggaaaagagttggaggctgatttaaattccatatgtagtatgaagttttcaaatatccagcatcagaaagggatgtaatacagtgctacaaaagtatacccatatctacacattatatctaaatatgtaacctatattttgggaagagagtgatatttatcttctgctcaaggattgtaaaaggcactatgtgatttttacagagtctgaaagttcaacatagcactccccatggaaaccatgtagtagcatgcattatattataaaaggaaatgttttaaatgaagtcattctacttctaaaaaattaaaagaattttttatattatgatacacaaatatacttttcaaaatattgccagggcaaatgaggtttaaaacaacctaccaccttgaaaggtacgaagatcaatgatattctcttgatacctgaggcaaagactggctaaagtcatacaactaagatctaatttaagagatcacacagtaggactccaggttcccaccataaatgccactaatccaggacgactgggaacccatgtttaaaccatctttgcaaaaggagcatgtgcccaagtgtgtaaagcattaaaaatatatcaggacaggcttgaaaaattttggaaagcagccccaaaaacataaggcagaattcttagaagacactgagtctagtctacctttttattggttttatagtttctccccccagtgattcctgagatggctacattccatacagagatgcacacattaattttaagatattcatggtaaacatcactgggaatactggatcagatcagcagaaacttaggactcaaagtttaacaagcttatacatcacccacgttttattttgcctactgcaagaacactgtaacctcacaactgtcaatgataaaattagttggatgaaatataagccaaatgcatcaaaattaaatacggagagaataatggatagatgtaataaattcaaattttaaatcaaaactgtctccaaaattttacccttaagtctcaatttacagcagctccttcacaggccctcttcttcctcataggtgcccactgcccaggcagcacagcatggtgacacagtgttccagctctggatcatacagactgcactgcattcacttccctactctgacaaatccaaaatgtgtagcactggacaagcagcttaagctcattaaattttacttgttttgcctgaaaaataaaataatatatgtgccacaaagggttctcgtgaattgtaaatgatacataaagttatagtaatagctagtatatattatacatacttattctatactaggtagtaaatagactaggtagtatgctttaaatgctaccacttagtagagaataagcatatgtatataagcatatatcatacaatcagtatatatatgtatatataatatatgctagctattattacccaatccaaacgtatcacatcaaaaatatttaaaccatttattttagaagcaaaaagaaccaaagcaattatggatacaaagcaattaatattctacctgtatgccatcctattcaaggattcaatattggccaacatcaaaaattgaaataaagattgcaaactgtaaggtaattttttaaatgttagaaaagaaacctatgaggcaggagaatagggtttagaggcagggaacctaaggccaattcatactgattttctagaactaaatcaaaaggaaaactcaactttccacacccaagtaacaaaaggatcacagactacttcctttgcaaaaccctccaccctcttcccagggcagaggcaaaatggaaagtacctctgattggtcccctcccacaaccaatcagactggtcacagtctttatttgcataggagtgtaactttgtaacttcacttcagcatctaattggtccccttcagcagccaatcagactgactgcaggccaaatcttcttctgtaacttcactttcagcctctgattggtcactttctgcaaccaatcagaatggttgtgggcctctacttcatttacacagagtgtaaaccaagtaagcaacatgaaacctctagagtgtatttaaactccagaaaattctataactggagctcttgatccacttgctcaagcccgctcctactctgtggagtgtacttttgtttcaataaatctgtgtttttctttcattgctttctgcattttatccagttctttcttcaaaatgccaaggacctggacaccctccaccggtaacacctagactctgattctttcttcaataattagacttcatcaatgtttgatacctaaaagtgtaaaataaaagttacatactataagacagctttttaaaaaaaaaatgctagaaaagaaacctagatttttcctttttctttaataattagatttcattgctgtttgatgcatatccctactagcttattctagaaccaggtttatttattgctataaagtaaaatataatcattaaagattgggcactgaaaaagacatttagataggagattatgttggaattaattttaatgtagacaagactctgctgctaagaggaaaataaatagcaacgtaaatatgcaagggaattcagcagactagccaaatgtcccagacaggagaaattttgaacatgatcaataaaataaaaaggagcaaataaatcaactcaatttaatgacatgggaattctaggttgaacttacttcatttgaattttagacagatcttggaattgggttaataaggctttgtaatgatctgctttctttttgcttactctgggaattaagaaaatagcacagtttgctggcacaactgaagtcttctgaggaatttgcttcactaatcttcagggaatttaatgacttattgggtcagatgtcttttgaaacctaaactaggaatccaaataaatttcaaaactaatgataacttgaatttgggttttcatagataattgttacattgctagcttttttttcccctcagtttattttaacatctactttttctttaaaatctgaataaacagagccagaaatgatggcaagtgcccgtagtgccagctactcaggaggccgaggtgggaggataccttgaggcaggagtttgaggccagtctgaacaacatagtgagaccctgtctctaaaattaaaaaataaaattgaacatatgaaacctataatgatatgaaaacaatcttccccgtttgtgtttgcatttttaaaatgtgttttgagcatttaactttgctttgtattttgtgcatgcattatcttaaggttttcatacaaagattaaattcatgacaataaaatgaaaaatatctcaatataatgccctttcattattaacacattcagatacacaaacacgctccatttgatgctaagatcacttccacttaagttgtaatgatattaataattaatgtttttcacaattacattcattaacatttctagactgccctctatgatccaggaaatggtctgtatgttttatatgtgttaatctaatctttataataactgaggttgctattactatcacctccattttaaagaccaaataactaaaaagcagagagattatgtgatcttgccaatatcacccagaaatggcagagctaagatttgaatctagctagcactccagtatataatctcaattatcacactctattgcctctactgtataacaaggcatacagcaattgtacatgtatgccttgttatttagaagaaacaaaaatagagtttcatgtagaagtatttggaaataaaacattgtctctatcttaaaagacttaagcaacagatgacatgattcattatactatttctctcttctgtatatttaaaatctttttcctgataaaaataatcttacattgaaacattatgctcatttgaatgatgtaggctctttggaaataaaactcaacttttttttattaatactatatgtagaataagaaagtgaaatccgcccaatttcctcaaagaattaatgtctgcagtgttttcgaataaacacaaaaattgacccagctggtcttaaagcttgaaacttgtatttatcttctctgaattcctttctcaggaaaccaaccatcaggcctccaaggaactgaaactcaccaaatcaccacattcagacaatgagacaccagaccctctcctaattcctgtttttcctgcatatagctacattcctttcatgctatataaacctccaattttagtcagttgagtagacagatttgagacttatctcccatctcctcagctgcaacacccaaataaagctttcttccctggcaatattctttgtctcaggggctggctttctgtgcatcaagcaatgggacatagactgaacccctggtgttttgttaaaagaacttggttctgatggaagaatataatacgcctgagttcatgtttcacaaatattcacacttgaaaccaaatatcttgatacttacatcacttgtagtaattacagacaaatattctaactgcactgcttattctccaatttcaattaattttggacctagggaaactacattgtctgttttaactctcctcttagtcctgatggctgtccccagggacaaaacagagaagatgagacaacactgtccactgccactctcatctgcatccaatcccattagatgaaattaaggaagcaaatgtctatcttaaacattaattcaaatatcatccatagtaaaagctagctttattatttcctctcttcattttgcttccactaaccttgaagcaaaattaacattttcatttccaccacgcttacaatatagcaccactttaaaaggtgaacacatcttcacaaacactatgaaaatatgggtatacaaatttaacaagcattatttcagcaattactgtatactataaaataaactaaatattatttctacctcaaatcactaaaactttagtagagaagatcaaaccctgtacacatattctattgtataaggtattataccattaaagccaaaaatgcattacaagttgcttagaacgctcataggaaggactaccatttgctacctacaaaaaaacaaggaaggtttaaagagagttattatttaaattgggtttttaagtaaagcacttgattggaggaattgtatggtatcatgatcaggtaattagcatgattagtcatgttaatattatctaggataagttaactggacacagcaaagattttcttacatatccagtaaggccatatgtgccttctatccttccatgagaatcacggctcatccaataatttatcccagttatacctgcatagtttgttttgttttctgaggttttttgtttgtttttgagacagggtctcactgtcaccctggctggagtgcagtggcacaatatcagctcactgcagccccgacctactgggctcaagcaatcttcccacctcagcctcccaagtagctgggactacaggtgcaccccaccatgcccagctaattttagttttttttttttttgtagagacagggtgtcaccatattgcccaggctggtcttaaactcctgggctcaagtgttctgcctgcctcagcctcctgaagtgctgggattacaggtgtgcaccacaacgcctggccgctacctgtgtttttaagtttcaagaggaaaatctgtttaaatgactaaagccataatttttatattatacaatcgtaaggagacattaattctatacttaatttcagccactgctttagctaaacctggctgtatttattttatagccacaaggtgaatataaatagcattgctctaagtggaggaacgtagataactataaaatgcccttgaggaattgtcttataccagagtccttgaagagcataaactttcccacaaactgactaattcggatgcagctaatagaaagctttcactctaaaggaagcattgatcaactttaaatacttgttttaccttggaggccatgcatcatcattataatgaacaaaatcaatagattacactcgaatgtatccttctttctacacaaacatgatcctggtgctacaccagcctaataaacacgaaagaacagtagaaatcaggaaattccaaattttgtcctgatgccaacatgtactaatctcatgaccttctttgtatgatttacttctattatgaaggctgctactacttcatctctactcatatcccatactcccctcccctgcccccacgttcccctgaatgctggtgttctgaggagtctatcttgtattgtcttaaggtattttttttaatgttgtgtagatgtgtgaagcaggctgaaagtagacaataaggagtagtggcattacagcaggctgcagaatatgttatatccaaaggtattcaaattcattttgtttttagctttgtgtaagcatgccaaaatttatctgtagatgaatctggccttactatatatgtaacttcacacttgctcaggaaatttcagccacttgttttcaaattcccctcataagctaaacataaaactctattctaggccactctcctaagcaaccaaactaaatacttagctgcctactagaaatctcctcttgaatatccttgagcaagtttttggtataaatgttcttgacttttaaaaatctttgtctgaaacactgcaggccttccaaatctacaattatatacagatttcttggcagacctgaatgtttccttccattaaatccttgatgattatatctgatacatgtgctttgacttgatctctgggaagacaggacttatgaatacacctatgaattctgaccttcatatttattaactttgttcccacattttttacttttctggcatttgaagagtacttctcaaacttattctgaggattattgataaacaattcacattgtcaaatttgttagtttctccattgagaattttgtttcagtggttttcattttgatggttttagtctactttttatagatcattgactctttctttggggacagtaagcatatattcaatgttgtttttctgcctgacatatctgaagtaatactatcttagagaagaattttcctctgtgtctttaatacttactttactgttactgagtatctcatggatttctccattgactggattttactttattagtcttaaatgaagaaaggcctatctagtctcaagactgggaagtagtctttcttccccaagtgtttgtccttggtgctgtcatatttgtaactacagaagtgctaatgatataaaacatttggtcctgccactggtcaacaatagggcaagcgttttcttcaaggtatgtatttcattgccaatcctctagattatagagacctacacaagtctggactaaggttgggatagtagggaaaggatctctctaaaaattaaagtatggggaagtaattctagaatataactatgacgtgttcttaaactatacttcagaacattccttttacagttgtgtgaaatgaagctttaatatgaacttagatttattgggaaagaaagtttgagtgattacaatgtgtactcgatattgtaagagttacatcagctgctataagtgcataagagctgctctctgggaacttatactcttgagggaccctaagataataattcacaaagattggctgtgccttcaagaaggagaaactttcatttcactgccaaacattatatgttccgcttagggaagttactggtaaagtttctgcacggtattaaacatcaaaaaaagagtcagtaataagtgacaaagatcttgacaatggaaaaagatatatgaatataatgtttataaatttatataataatgtatcataattaaatgcatttaaaatttataatcataaaatgagataatttcaatagctcttaagaacatatttgagaccaatgtctaaacttagatgattgtattagagcagtgaaaggaaatgattgatatgagtactaggaaatcctggaaatgatcactaatctactagtcttaggagttggaaaacaaatcatctccagcagaactggtgaaaaagttaaaataaccagagcctcaggatttataatcttttagttatacccaggaggtataatatttaaaatagaaactttatttagtgcttgttttttttgttgttgtttttgtctttttttttttttttttttttttgagacagagtctcgctctgttgcccaggctggagtgcagtggcacaatctcggctcactgcaagctccacctcccgggttcacgctactctcctgcctcagcctcccaagtagctgagactacaggcgcccgccatcatgcctggctaaattttaaaaaaatattttttagtagagacagggtttcactgtgttagccaggatggtctcgatctcttgacctcgtgatctgcctgcctcagcctcccaaagtgctgggattacaggcatgagccaccgcgccggccagctcttataaactaaatttgtcctaaggttacatttgtattttgaatttctttacagtaaactgcagcctaacttagtatgttaacaaactgcaacctactttaaaagtatattcttgtaactaataactgagtctcagctaatcatagcagctgagtttcagccaatcacaggctgcccactgatcagattatgtccacagaaggcaaatgctacatatgcccaagtaaggtaaatgcccagctatcaccatgcccaagtaaggtaaatgtccagctataaccaatcaagctgtttctacacatcacttcctttgtctgtctataaatactgcctggccatgttgctgggtggggctctgtcctaattttgagtactgcctgattcatgaatcattctttatacaaataaactcgggtaaatttaatttatccataatttctttcaacagccctcggatattaatccccattgaaacatactgaggactaaatttattaataatgttatcccagcagttagtatgccaattagccccactgttttattagttgatgtagacgtatgagattgtaaagttacattttataatctcaaatgacaaatttttaatgaagaatatgacattgtagaatttgaacaataaaaatacatagctaaactagcatgtataaaagtgagagcaaagaacagtgatagtagccaaattcaaacaaaaacaatgtgatgatatgatttgtgaacacctgatatataaaataccagccaacgcatatataaagttgtaaacaaaagatccaattaaatccaccctgtactgcaaaacttttggtgagggtgagtaaatttcatcatccataggagtctaacttcatgagataagtaacaatctttttttaaaaaaaatgtaaatactgaaacttgttaactagaatatcaaagtacaacatgtatttacagttcttgactttcactgtaatatagtaaatatttctattgcagaaaacaatttgatcattagttatcaaaatgcattaggagatattagaaaaaactcagtacagcacccaattttatattcattttactatagaaaaattatctcccccaaagggtttgattatatttaaaagataatagtcactcagatgaatgagtagagtgtttgcactaactttaatatgtcaagaagaacaaattgaagatatgtgcagaaactgctaattaatgatctctcaattactatcccttctctctttagtaatgtaactctacatgttagttgggtatgtacacatgggtcaagggttgggaggaaaagtactccatatcctcttgcaacaaggcaaggctggtcactaagttgtggacaatgggcacacatagaagtgatgtatgcaaactctgagacatgcccctaaaggcaaagggcatgtctcccattgtcacttgcctctctcctctaatctagaacgcaaaaagaatcatggatattggaacaccgatcttggagcacaacatggaagagctacactgaggaaagcagagaatggggagaagaaccttgagggctggaaagacagggagttgctgtattagccagtgtatccagaatgttcctagagaggaatcaacttctgtctaatttaggccacttttactttaggtatctctctaacagacaaactgatatactaatcaatacaacataatttgttttgattcaaggtttaagatcttataagagcattagcattatgttctaaagcactctgagcttgtccaatgaaaaattttcagtatacaataaattatcatatagttctttacaaattctcagaaaaattcacatgaaatattccaaatacagaaaactgaatgatgtcacaaggatcaactttgtattttacactcaggttgatttgacatgataatttattggttttttattttataaagcattctacaagtagaattatatttcctcatgtgatttctcccattttttctcttaacaaattacattcttgctttacttgagcaatgacagccttaaacatggccaaatgcaataaatatttacatactgcttacgtatatcagcaatattcagacttgtgtaaaataatattttacccattattatgaaatccatattaatatacagatttcacagatatgtaaacaacctcactttggctcagaaactttcacaagtcagtgagcctgaaaaaacatgggtttcccatgttgagggcaaaatctgaatactggaagacaagtaatcaaaacagtgaaaaactatttgaatgtgttagattatcttttaatataatgctgagcagcctgtgaggaaataatgtctctgtaccttaatgatggtagaacttggtctggtcctttttgtaagtgatatcgcactatgtatcaaaattcattaaaatgtcaaaaattaccacttttgggaatctatcctaaaaataagtttaaaactttgaagaataatatttatgtgtaaagatgtactgatatttatgtgaatactcacaaaggaaaattaaactccaaggtagaagtggagttaaatgaattgtgttatatcagctcaaaagaatgatccaacaactatttcccaagataaaaaatgattatgccacttaataacttgtgtacttaaagaatcatgcagggccgggcacggtggctcacgcctgtaatcccagcactttgggaggccgaagcgggtggatcaggaggtcaggagatcgagaccatcctggctaacacggtgaaaccccttctctactaaaaaatacaaaaaattagctgggcatggtggcgggcgcctgtagtcccagctactcaggaggctgtggcaggagaatggcgtgaacccaggaggtggagcttgcagtgaaccgagatcgcaccactgtactccagcctgggcgacagagcgagagtctgtctcggaaaaaaaaaaagaattatgcaaataagtaaacatatatgttcatgagaaaatattaaaaatgtaacaaaaaaccaacatgcttatagtagggtaaaagtcatgaatgccatcttcttccctccttttgactattaaattctataatgtggtcatattctttatccatttaagtatattctttatgtataagtatatattttcattagaatctaagaatatccagaactgaaatgaacgttatggatcacctattcatctgtatcatgtcttagatgagagaataacagttcaaattttaataggtgttaaagccctaggatgactataattttagggctggattagggcatgaattattctgattcctattctagttcagtttgcacgaaacaacactctttgcgaattattctgataacgttattgtttgtatataaagcaattgagttttcttcaaatgctgaccatcatagttttaagttttaaatttaaatgtggacattttactatttataaggctttaatttgctaaatttcacctcatggcagaaaacagagaaggaatccttatcctaagcataaatatataacccacagtagtagtagatactatttttttagatgagaaaatgggaaaaacaagacaagtttaataagttcacttacacatttttttctctctcaagagactttgatttaaacatttgaatgaacattagtgaaggcaaactatgtaacaatattagaacaactgaagtattacaaatagtaacacgtgcacttttccacttgtagtggacatatatgctcaaatgggcaactttgaagcattgattgaaactggagtgatagttactaaaaagtcatattgacaatttacatattattgttaaaatcttgaacaaaagaaaatcaccaatttcaatgtaaaataaaaattactttctaaataatgagcaaacctaaataaaactgtttcacatataaatgtaacttctttaattagtttagagaagaaatacttatttgcagtattggtttcattatctttatgcaatccttaattggaggattgcacgtcaatgccattcactttattctaaggctttgtcatcgctttacaaattaaatattaaataaatgttgcaatttatgtaccaggaaggttgatgaagattttgtatatatttttaaataagtttaaaaatatcaagtgctaattataatggtgaaactaaacatctcttcaaaaatggtacttattttgatatcaataaaccattaaaacattttgttttagttgacagtttgtacttaataagcctcctacatcattaaaataatatatacaatcatgacaagaggaaagatgtcatgggaacgccacctatgtctagaggaaaaaaaatactttttaaaacactcttagctcttcaactataaactggagaaaataaaaccttcttcattaacagtattgtaggaactaagtaaaataagttgtgtaaagtggttagtagtatggtttgagatggtggtggtataatttgttataatttgggaaactgtgacattatcaagccattatgtgttttctcattttttaagaccagatagacttgttttatgtattttttcattttcttcttttaaatagctggaagaaaattccatataatagtatataaatacaattattttgattcggatgagaaatgtgtgaaagacatgtaatacttttattatatttgtttgctatgtttactgaaataccccaagctcttaaaataactaaaatataggatgagcttaacaaataattttatcttaagaaataagtatacataggcatttttttgatctaagagtcaaatacaagaattttaaaaaattaagtgtaacctttattagataacttcgcaactctattcaccaacactaagtaataaatgtgtcctcaatgtctatccagatgtagcaatattagaagtaactgattagcactaaaataatccatgttttcaagtcatttaaatgtgtacattagagtcatttatttaaaaagtcatatggagcaactactttgtttcaaagactgtacaagcagggcaggttgttgcacagcttctggggtgtcattcatattgtagttgaagtaaatggttctccctggtgtgcaaagtttaagtcaaagcagataggcgtggtgaccctggtgacaggagccaggatacagaagtagatgggattggatagctattttcaatattgctaatggagtccagagtatcacagttggtacagaggactgtggtctggaaaaagtgcagtgagggttcagatccagagaaacacatggaatttttacttaggaagatgccaagaataagttgttaaaaatcacaaaagttcttcattatctcgtatctaactagtattttgctcatgcagtctaacattgtcttaaaaactaaaactgctagctcaatttattctatataaggccaatcattttactataattttcttggaatttaatggaaaacatttaatactcacatcgagatcatcctttgcattgtagtagacaacttcattgctctacaaaaaaaaaagaacgctttattgattttaataaaaacaatactgtatcaaatactgaatacattttatgcatattataaaataaactccttgtcatctttctttcacaatatattccacaatgatccataaggattagccactatttttccaggaacatattaaaaccgtttatcagtgatattacatcttgcattgggaaaaagatcccagtgtaagtctgagacccatttgtcaagaaaaaaataagtgaaaaattggtaagtaaaataaattatagacaaacacatatatacactgatatattaatacacaatgaacaggataattcaagaagcatgtaagatacgtgtcttaatactttgttgaagccatgatttttatatacatacacagagtgttgaaatgattctggaggaaatgtgcatctatacaatattggcagaaatttactcatggagtcagaaaagaaatgatgagcaccagggaattcagatagtaaaaaatatcagattatctcacactaatactctcatattctagcaaagtggtgaattagcattggtgttctagcaagagtaaatatatatggatgactctgctagccatcagtttcctgaaaaataccataaatataaattagggctacaaactatgttagaaaggaaaaatggaaatggattaataaaatgactgtcaggaatttaaaactcctattctttgtgtctctgaggctagttctatgtagtgtaaaaataatccacttagactgatttctctatcttattccaaactgattgaagatatagttcatcttccacatgtcttcaagtagtaaactcactacgatgtgaacacatatttttccctgcctcttaaacatccaaaaacatagatgctgtaaaattttaggctgacgcggtggctcacgcctgtaatcccagcacttcgggaggccgaggtgggtggatcatgaggtcaggagatcgagaccatcctggctaatacagtgaaactccgtctctactaaaaaaaaaaaaaaaaaaaaaaattagccgggcgtggtggcgggtgcctgtagtcccagctactccggaggctgaggcaggagaatggcatgaacccaggaggcggagcttgcagtgagctgagatcgcgcgacagagcgagactccgcctcaaaaaaaaaatttattaaaagcaaacatataatacacaatttttaaaacggaaattacttgggaaaagttcactaaattagtgcttctcagtgtattccctttccccctccccgcaaaaatcactacttcttcaagatattaatggatgtcatgtgggcaaaagcattccatgatcatatgactttagaatataataaagttaaaattgtctcttttcggcagaacttcacagagacaatgtataactgtacattataaatctccaagaggaaaatacattgtgttttctcagtttatttaccacagaaatctgcctgtttttgtttgagaaacataccacgagactgaaactctaaaatataggtctccatgaagaccaaacaaaccaaaaatgatataaatatcacagcatatgaatcataatagagactgaaacccatgaatttgaatttcatttagaatcactaaagttttacattatttgattttcaaaagaattattcagtagctaaaaattttaacatgcataaaaattctaattcctgaaacatttcttatagcattagttttgttttttttgttttttttgtttttttttttttttgagacagagtgtcgctgtgtcgcccaggctggagtgcagtggcgcgatctcggctcactgcaagctccacctcctgggttcacgccattctcctgcctcagcctccaaagtagctgggactacaggcgcccgccaccatgccccgctaattttttgtatttttagtacagatggggttttactgtgttagccaggatggtcttgatctcctgacctcgtgatccgcccgcctcagcctcccaaagtgctgggattacaggcgtgagccaccgcgcccgaccttatagcattatttttataaaaaagcagagctcatcacatgtgcaaagcaagacaatcttctgaatccacctgagacccaaacctaattactagtttattgatcctgcttgtacctctgcagtttatacttaggagacgattttcaatttaaaatgtggattctacgaaaagttaaagcactgaataagttcatcttcattttagactttattttctgccatctgcttgcttatattaacagaatgggaacacgtagaaaacaaggtgaggctgcattgaatttcaagcagttcaacatcgtcattttcaacagatactcactaatatctatatgcacacactgttgtgccaagaaaggcaaaaaataactcaaacctatcaactcctactcttttggtaaaataatggatacaaatcagttgcataaaacaacatatgtatgtaggattacacttggtccatggtactagaattaatgattagtcaatgtatttcctagtaataaaatataaataaataatcatcaaggctaagattaagagtatttcacctagtgtcagaagggttacaagtatgattttttaagtgccagtattgatataaactaagtattttgatcctgttaagagctatgcatgaaactaaaattaagtaaaattaagaattaaaaagatctaagtttatttgagaatttcccaatggttttgtttcccttttttgtgtactacattctacaaaatctgttacttatctcttctttcagaatgagggtccatggtacaatgatgagcactctaaactctgaaactctatgttgcttttaaaactgtcattgaaaaggtgcatttcaaagttcagttaagtgttaacgaatttgtacaaggctttctggattctggattgcatataattccaaacgctgagtttttaagtaaactgaagaaacaaatatatattagttataaaattatattgcaggtcaaacatccatactcatccatactcctttcttgttactaagtatttgacatttccttttttttttttttctttattgagatgaagtctcgctctatcgcccaggctggagtgcaatggcatgatctcggctcactgcaaattctgcctcctgggctcaagcaattctcctgcctcagccttcctagctggaattacaggcatttgccaacacacctggctattattattattattattattattattattaacggtgtttcattatgttgttcaggctggtttcgaactcctgacctcaagtgatctgcctgcctcagcatcccaaagtgttgggattacaggcgtgagccaccatgcccggccttgacatttccattctaaaagagttctttctcaatatatcattcatttatatggtcaaaatatcaatgaaaaaaacaaaactgactttttatagaaaacaacaaaatgagaaagcacttactcaaatatgcatgcttagacaggctgtcacattttaagaagagaacgtagaccttagtggaatttgcaaccaattatgtcccataccgtaaaactaaatttcttcttcaccaataaatgggatattgcttttggcttaggagcatttttacaaacctcatatgataaatatgcttttctttcccaaaccccaaattttcattcatagcatatacatttcattattcccttatttcatgaaacagaaaagctcacttgatcaattttaataagaataaatttatacagggcatcaggagttggagaaactaactctgcatctgctctgtcaaccaaatccacctctatggaatatgaccttaaaataaatgccaaatattcaaagagcacttaatttatatcaccacatcaaaatattttccaagtctcagttcatattttcttataaaaaaaaattgcaattggctgggcgcggtggctcatgcctgtagtcccagcagtttgggaggccgaggcgggtggatcacaaggtctggagatcgagaccatcctggccaacacggtgaaatcctgtctctactaaaaatacaaaaaattggcagggcgtggtggcgggcacctgtggtcccagctgttcgggaggctgagacaggagaatggcgtgaacctgggaggtggagcttgcagtgagctgagatcacgccactgcactccagcctaggcgacagagcaagactcgtctctaaaaaaaaaaaaaaagaaaaaaaaattgcaattattcgtttgtgatttttgtttgaatgctttcagaattatttggctcagaaacaatttcaactataattttgagaaaaatcatattttggagaagcagtcattctctttcctatcaattcatttaaagctatctttttgctatttagaaatatatattaagatatgtccagctatgttaactaaatcagtctttcactaggagttattcaaatcactgagtcaccacaatatatccagaaccaatcttaacagaattgggaaaggacaattcttaggaataaaagatgattcacaccaaatcaactaaattctgttctgatgcttttatagatatgagttttacttaaaatgaattctgtgctaatagaaaattaggggaggaaatttaaaaaaaaaaatgaagttaaatgccttaagtgggtaaaattaaaggagaagaggaaaaagtctcagctgaattctttctcccttaacccagtctcctgttcccatcccacttagactttgtacagggagattttggggtttcaacaacaatcgggggagccacaccactcattcaacaattattttggcaaccttctccgtgctacgtattggagaaacgaagatgaataatatctacaccctgaccacagggagcaagtgttcaccctacaactcgtctgtggcaaggatctgacctcgtatatatgaaaaatatctcattatggttggatgacatgaccacataaactaaagctttctcagttttcaaaacagttgagaattaacaattttagatagtcaagacattgcccgtctgttgatcagtttgagcatatgtgtttctttcttaatcatttccctgtcttatcactaaaaattccctcagtcccttctctagaaagtacagttataccagtatcatttaatactttaattaaaactatggcatataaactaattaccatgggaacaaatgatagaatagagtaatcttgtttctctattatccttcagcctaaatgtctttatgcaaattattaaacaacatcatcttggaaggtttcacactcaaatacacaggttttcagtggatttcaaggcattatgtgcagtatgatagaataaagtcagcaacagcttcaaactagattcagggattaaacctttggagagctatttttcataatttaagcgccaccagatgacaagaacaaattgttttctttctgatttttaaccatgcagtttagttatttattatctccttgaaacaaatttgcccaaatggtccatgctaatataatactgctgcttactgaaatttcaaacatcccctagcaagttgagagataaattactttagtcccacattgtctcttgggagtcaaaaattaaatctgagcaaaatagacctttccatcttaaaaatgtatattgtgagtgacagccccttgcatgccacttgctcacaaatgtgggcctctgatgaatagattatgctaaaaatctgaggcacacatgcaaagcttccccatggaactaagatgttgccaggaataaggcttaaatattgcaactgaaaattaagattttatagtcaacaattaaaatatatgacacattcaaaattcaaatagagactaacttcctgtccaatttactaattctctttcttggctatactcagctctgcacatgattcacagcctgacaagttttgggcaactgtactgtctgataaagtcacttttacaaaatattgcaatcttattgtcatttttatcactcctgagttccaaataccaagtcaattggttaaacattgtagatactcttcattaaaaataagttatgttaatgattcatgccagccaacatctacactgtttagctaaaatcatttatagctcaaattttctggaaatacatttgtagcaatttgacttagcaaccactgctattttgtccattatcaactgttgtacctgggatgagttcaaccaacagcactgtaacactgtgtgaataaaagaacttaggaacatgtatgtgtgtgtatggctgtctgtgggtgtcagtggtgaggggggatatgaatgtgagtaaatcattttcaagacagtgctccaggaaaaaaagtattttttcctgtcattatatttgtttgaagtttggaaaacatgaacatattgagaaagtatgtaatttagaagatgaaaagaaaaaataaagatggacacaagaccatctagagataagtgctaccatataactgaactgaagacgtgataaacctgcattcatattatgtgacaagagacaataagataattgatataaagtgttaagtacagtgcatggcacacaatatatgccccgtaattgttaactactttttatatatgaaaaatatcaggaatatacatccatagaatttatcaattaactttagttaatacctacttatacatgaagtaaattataattttattttcttagatcagttaggatgcaatgtgtcttttaagtgctatcttcaaagattccacatagcagagtggagaagaaataaaattactagttgttgtcatgctttttaatctgataaaccaaatgagatgatttataagaaagcctaatgcaaatggtaattaattggagtggaaggggcttatacgcatcctgtccaccaaatgtgttgctgtgctccagacctgtgtgattctgtaactctccagtctacatgtacacctccacatatcaatcatcattcattactgcctataaaaactttcaccttgtattaatctaaaagtttgcttgtccatcccaacatccaaactgcccaatcttgctggagaaaattacacaccagtaaatcaggagtttctatgttttaaaaactctaacaaacatgtagggttctttggtaaaatgtttttctattcagaaatcctatagcttttcagaaactgtttattcacccaatctaatcatgtgattctgtctggctagtaaatcacatcaccccacttatctgatgacacaaattaacaagtacctaaatatattcaaaaactgtattccatctctctatttctttgggtgtaataggtctaggagtagttacggtcataaaagctgagctggttacagcctgaatccttgaggcttccttcatctgttggcttcttggtgataggaaaaatcatttttttttcttaagctagtaagaatttggtttccaacacaatcgatagtactgatactaataccatacttcctacaatgttttcttcgaatctgattttctattactaatagtattatttgcttaaagtttaatttttatttgtagctttacaaaaatttcagtgttctagaaataactcctaaatctgtgtcctagatgctagctcctgctgattcattaagaattccatttcttcatcatcccctttttctcccctgtgtatccatcttttatttaatcacattcaggtaatttgcaaaatgcaactaagagaatttgtggaataaaaactcagatgtgttctggcatgaaatattttttcacctaaaatttaaaattctagcagaaggttaaaaaaaacatcaaagaagccaagttcaatgtttccttagctcctatataaagcattttaatatttttctaacatttctctaatgaactaaaggtcaaaaatcacctactgccaacttaatattttataagtggtatatcagtaatcattaccatttttaaaatgatggatcaatttttttacatcaactcttcactagcctttaaaattagttgcataataaaaaatcaaataactctacattttgattgcatgcttgaatatcagagttttatttaaaaagattaaagtaaaatgattttgctagcgtggttcaataatgtatggattataatgaaatcataatctgttccttctttgaattctcagcattctttcatacgaataaataagcattgagctttgtacacatgctcagcctgatttaggttagaaacctaaacacatgtgttttttgacaccctgattactaaagatgacccagtgagttaaatattctcaatgtcattttatgtattgaaaagctaagactagcaacagttaaactgagtcttcttatcctcaatcaaatacttatacctcctgtgtactgctattatgaatgcagacatgacctacatcttagagacagtgaattttatatatatataaaatataaattatataaatatataaattatataaaatatataaaataaaataaaaaataaaaatatataaattatgtaaaatataaattatatataaattgtatataatatataatttatatattatatattacacattatatattatatattatatatgtattatatatattgcatattatatattatgtaaattatatataaattacatgtataatttttatatatgtttatattttatatatataaaattcactgtatagatacagaatgtgtgtatgtatgtatattctgtatatatacagaatgtgtgtgtatatatgtgcgtatatataaaatttttacatataaaatttatatatgtaatttatatattttacatatattataaaattacatataaaaattttatatgtaaaaattttatatatatgcacatacatacatacacacacattctgtatatatattatacacaattttatatatatatacacacacatatatacctatatgtacaccctctaaatagtttacataataaaatagttaatctttgagacacattcattcactttatccattcttttaactttgtcttataatctacattaaaatataaatttaaaattattattaatttatttcgcttactggaagaacaacaaaaagctagaaaataattttggccttttgtaagcttgcttctgttacttttgccacatatcactttacatttcttcatccggtattttccgttgcataattgtaatattttagtctgcttattttttcagttgtcattatggtgcctgtaaattaaagtatcacttcataagttgtccggcatattaaccaatctacaagccaaagccatctaagaggagtggtcacatcgaaagataatagatccatgtgtctttactatgtttaataacctaactgcaaagatactcatgtactacagcccagagctgaactatcatgctggtgacacaaatggaaatacctccctagaagaaagaaacattcatgacgttcactaaaaggaactgctcatttcttctacatatatatatacgtgtgtgtgtgtgtgcgtgtgtgtgtgtgtagaagaaatgatatatatatatctttacatatacatatttatatttatatatataaagatatatatttatatatatctttacatatacatatttatatttatatatataaagatatatataaatatatatctttatatatacatatttatatttatatatatataaagatatatatctttatatctatatatatatcttttacaggtaagaagattaagctactacagtttgagtagagacaatgttctattgtgcatatactcaatgctagcagtgtctggaatgctgtatgaagtgctactgaaagggctgataaatgattaaatgaatatgataggcctatgagcaactattacaaattcggccaggcgccttgactcaggcctgtaatcccagcactctgggaggccgaggcgggtagatcacctgaggtcaggaatttgacaacagcctggccatcatggtgaaaccctgcctttactaaaatacaaaaattagttggccatggtggcacacacctgtaatcccagctacttgggaggctgaggcaggagaatcacttgatcccaggggcagaggttgcagtgagccgagtcagcaccactgctctccagcctgggtgatagcaagactcccatctcaaaaaaaaaaaaaaaaaaaaaaaaaaaaaaaaagcagctattagaaattctaataaaataacaagtacacacacacatacctgcacacatacacataattcataacagtcaaaaaaaaagtgtagagctttacaaaagctcgaataagttaaaaggtaggctactttcactctcataggaaatcaaggagaaattccaagtagactgatttcagagttcattggctcttgaacttcaaaggagatcaattcttattaaacattaagagctatatcaatttatttattcatctgataaactttaataggaatctgcctgtaagctattttggtgttccaaatgatatcaataaatatatgatttaaactctatgagaagagcaaaggtagaatatgagaaggtaaatatattattttcctcaggcaccaaatctcccagaaacctcattccagaactgaacaaacacattcataatgctgtggaacttgctttaatctcctttaatctgtaattccaatgaatctttagatataatcatctaaagcattaaaatttaatcttctaaaacatttcatttcttatgtttcttcctattgactcagacaccccacagatcttcttgactcatgatccaggtcaacagcacttgatcataatatatgatgtcttagcaagagagctgttaatttgtccaatggtaatattagcccttcctctccagattaatcattatcaactccagattattatcctactaaaacaaaatatgaggattaacactatggtcagtgaataacttagtttaaaataatctgttcaaaattggagcctcaaagaacattaggttggtaatcactacatcaatttcattcatctttcatcgggcttatagggatatgtaggataggaaataaaggtagtacagggacatttattatgtgtctattatgaaataaacattcacatatatacagtactccttgctcatccccaggagaaacatccaagacgccccagtaaaggcctgacactgcagatacagataatattaatatgtatacaaacttataaggtttaatttatatattaggcacagtaagagattaacaacaataatcaaatagaataattaactttatgctggcatcactattctgtgaaagtggtaacagctaaaacaaatatatcactgttcagctcggatagtgcattatgttcctataaggcaatagtcttaaaagcaaggcttgttaaagtagaaaggagatttgtaagtttcaaaaacagatgattttacatataagacaaaactaagaagtctaaatgatgaggcatagttagaaaaaaaaaaaaaagtcaagggatgttcctccctattagaaaaaggaatattgagaatttcctaaattgaaagagcaaaagaaaagctgaaggagagagctaaaagtgacatgtatatggactggctccagttataggtaggaaacagtgggagagcaaaggaggtgtgtttgggagaaatttgccacattttctactaggagtctggaataaagacttttcattattaagtaaaataaaggtgcatccaggaagctttctttgccagagaaaactccccagcttccctgcttcatgtcaaaattggacaaccttgttttttgtttttttggagatggagttttgctattgtcgaccagctggagtgcagtggcacaatctcggctcagtgcaacctccgcctcccaggttcaagtgattctcctgcctcagcctcccgagtagctgggattgcaggtgcctgctaccatgcccagcgaattttttatttttaaaagaggcagggtttcaccatgttggccaggctggtctcaaactcctgacctcaggggatccactcacctcagcctcccaaaatgttgggattacaggcgtgagccactacacccggctggacacccttcttaatgcctctcatagaatcttcttgtatttccccactctataaatcagagagaagagtcactacacatcactggtttgttgtattgatgaaatgggcaagtatctgggtcaaggatcggctgcattccctgcctcagtctgtgtactcagcacagcatagtgtgatcacctgcctgagccctgtgagagactacaccttagccatgtttgagctcaatgcctggcccatcacagcttagatgtcattaactactaaacaagccagcctccctcataaggttgttgaatcatctgatgaattatcttaatattccacagacaagatgttcactgactggtttttaacactgtcctaggtttggttacctagaaatagacactgagactaggatttgagcatcatttatttgggaggtgatcccaggagacaccaataggagagtagagaagtgagacaccaaggcacacaagctgtggtcaagagcaggtagacaactggggctgtttccctaggaaccctggggaggctatatagaatttcactcaaaacggtcacatccaaagaatgaggaggctcaggtagtatccacccataccaactgtcactcggagtgttcactcctgctcattctggccacctgagaaagccctcaaggccaagatgtgcagatgcttagaggaggaagctataagagtatgtgcttggccgggtgctcacacctgtaatcccagcactttgggaggccaaggcaggcggatcacaaggtcaggagatcgagaccaccctggctaatacggtaaaaccctgtctctactaaaaatacaaaaaaaaaacaaacaaacaacaaaaaaaaaaacattagctgggtgtggtggtaggcgcctgtagtcccagctactcaggaagctgaggcaggagaatggcgtgaacccgggaggcggagcttgcagtcagccgagatcgcgccactgcactccagcctgggctacagagcaagagtatgtgcgtgtctctgtgtgtgtacatgtgcgtgtgtgtgtgtgcatgtgtgtgtgcatgcactgaggagatgtgggcagggaaccaacagcatctactataggcatgcagtgagtgttttaaaatgcttactgagcacatggctaaatgcttaaacggctttaagcattgactagttagtaatgtggcttcccgaggctttggttcctcccctgtgacataaacattcagttgacaaatacggtctctagaatccttccacctttaaggtttggtgtttccactaactgctttgctttagatcaaattaaaaaaaaaaaacaaaaacaacaacaaaaaaaaacaccctagtagctgggttcatctactttttttttccccccagtaagccattattttgcttctcatgtgagcacccaacagaacttaaagagccatctctcttattctgaaaacaaagcaaagctttcccttaaaaaaaaaaaaaaaaattgaaatctctagtacatatttttgtagaagcatgtaaaactgtaaaaaagaaaaacctttgcatcattttttttctatcttgaaaggtcaagttaaggtgtattcatttattcctgaaaagtaatgactatgttccaaggatagatgtttgcaatagaaacatccacaaactaacctaaatcaacccctttgcacctaccaaatacaagctggcaatttccccattatgatataaattacctgctacagatcaattgctgctctctttcattaatataattaaatgacattcatttgtatttaactgaagtagaaatcagtgtttttatagggcatagattacagtttaaatctgtactgcttctttgtaaaaaaattttgttaacagcacaaagaaaggaaggctgttgcagaaggaaaaaaaatgaaatggcttcacacattaaagaagcacatttgaataatatataattgcttggaaacaaaaatttctaatagcttatgtttcattaccctagttttagtaactgtatttaagttatatttcaaatagctttttaaattcaaactgtttactgattcagagataacctgtctttagttaaaacatgcataattgttaaaatgttaatttctgaaagcaacaatccaaaagattctcaacaaattcaaaagactctcaacatagccctagttaaattgtattctttatttcatctcttgtccaaatttaaaagaaaaaagtaaaggagaggcaaggaaagggaattctgtggaccatgcttcattcctcaggcatattttcataggagttattttaatttcaaaatgcataattgtttagtaaatgcaatcttttcttttctttagagtagtaaatgaagatctgtatacttttccaaaaaattacagacaaagttgtaccaaggaaaggctgaatcatggcaatacagatgcactgaatgtcaaatttaaaaatctacattcttttccttggtgcaattcttagtccatggttgctaacaaatcaatctatcctaagttgttttggcttctcatttatcaattaggcaaagaattccaaattcagagcagtataaatgaagaaatttggatggtttttaaataagaaattgaggtaaaaagaagataaactgaatagctaaagaactaaataaaactacttcagtcataagaggctggtgtcacttcggtggagagcaaaaatactgcagagaagctgagccaattacagagttgtctacattttcaactgtgattccagatgtgttatggaacaaaggaacacatcaacatactcatcttttgatcatattaacttctttctagcacgtaagaaactcagtatgaaaaatattttacatttaaagaatcaagcaatttcaaagttaatatccaggtgagaagaataaagagaatgtattagcacctaattaacctttacagacacaattccctctctacaaaactagaaggaggtattttttcctccaacatgttgtatatttttgtccactttcatggactgtttagtaaaaacatagcagatctagaaacacataagaagaacaagtgaactgaaagcagatcaagtgagattatatctaagctttatattccaaagttaaatgtatcaaactatatatttacagaggacaagctaatcctaaaaatgattaatcaatgcttataagtattaatataataatatgccttccatttaccatcatgtaaatgatatgaaaaccacatttatattaatataattcgcctattgtctagaaattgtttagagactgcccccccaccccccaaaaataaattagatcttaatatacaaagttgagctcaggctaagaattttcttaaaaccttaagaaaaggttaatacttgagaaaaggtaaaaccttgagaaaatattaatactaataggtttatcaggaaaaatacaggacatccaattaaatttgattagatgatgaattctttctagtaaaagtatgttccaaagttctacaaaaggtatagttacttgaaattcaaatgtaactgggaatcctgtgtttttctgtactaaatctggcaactttcatttatgagatagtattatatcatttatatggattttacattatttctgataaattttaaaattcaatattgttgcagaaattggggagggggagaatgctacatcactaaacactagctttgaaattaagtcaggaacatgatcttaaaggaatgacatcaaaattgcaaacagccccagtccttagaaaatgtaattacccagaaaggccaaggtgtatttctgtttttcaaaactggagtaactctttagttaaatgcattatatgtttcgatggttacttccaattttacatatagaagaattattgggcattgttcatttaatttctcattttgaaacatactaaggcaatatcaaaatggctgcattggtaatttagtaatttattaactttcgagaacattcataagagggaaacatggctgtaatatctgccatcccactgatcacctaagctgatttctgtgaactgatcagccaggcagtaacattcaaagtagattgtgcaatccttctaaacttgcacactagatcaaatgaaattactttcagacaggcactattcttaatgtcaaaggtatatgaaaggctgagaccttggcaaaacctacaaactcagcattttaagtgatccttaaataactgttttcctttttgaagttttcttgccaccagttattctgttgagatgaccaggagcctagctctctcaggaattaatgaagaattaaaactgagataaaaaaatctggacactaaaagcaaactagttatatataaacaaaacaggaaacttgaaagaactaggtggcagattatatatgattaataaaatattttttagatcttatttctaataagtttaatcattacaaactcaaattcaaatttccattaagtagaagacaaatgcccaattgcacaatctaaagttgctcatggaaacatttttctccagtcttcatttaaaagacccttggatctaaagtggtatctaaaattgacaaattatgtaatagaatctctaactatataatataaatttatttgtgacaatcatcatgactacgaattccaatgccttaaagcttttaactatagcttcgtatgactacttcttgatgtttaattgaccagtcattgatttataactggattatgtatagggataaagaaaattgttttaaaatgttctgatgaaaagttgtcaaattcctccctccacccaccaaaccttaccaagcatcattgttctaagatatacaattctacccttagagcaaactataaaaaaaaaacacccattgaacagcacagttaaaaataaatatttcaatgataatagttttaaagaaaaacacttaggaggaagaaaaagataactgttgcagagcttgtaatcctgtaattaagcattaaatcttgtgttaagcttcttgacagactgggagaaaaggaaatcatgatcactagcatgattctctgtatgtgatgaaaaggataaatgagattttttgccatgagcaataagcttctgcttataaccaaagcctgtaggaccgtgaaaaacataatgtgtgtagttctcaacaaacagaaaaagatgcttcacataacgtctgtgtgtctcaccctgccccatatatctgcatatgtaatgattatctatatttgtataaaaagcagacaatagtctaatatcacttttaattttttaaatatttgtcagcagaacgctcaaatgcttcaagaagtatgtgagttttgtacgtgtacagagaacaaagaacctgagataactggcactcaagtttccttccattagtagaaaggtatggtatgtactgttctcactcctaagtgggagttgaacacatggacacaggaaggggaacaacacacaccagggcctgttgtgtggtgggggacaaggggagggaacttagaggactggtcaataggtgcagcaaaccactatgacacatgtatacctaagtaaaaaacctacgcattctttacatgtatccttgagcttaaatttaaaaaaagatatggtatgcacacaaaaaatacatgctcacgtaaatattgaagaagagtattgtactgaaattaaagaggtataaaatttgattcagaaactgaatgccatattctgttttcagattgtataaatctttgccttttataaaaaatgaacactagttggtctttgtagagtcatttctagtaaaacaaggtataagcaataatgataatgtggtatctatccatttattgattcaatatgaaaactatctgatatggtttggatctacgtccccacccaagtctcctgtcaaattgtaatcctcagtgttggagatggggcctggtgagaggtgactggatcatggggcagtttcttatgaatggttcagcaccatctccttggtgctgtactcatgagagtgagttctcaggagaactggttgtgtaaagtgtgtggcacctccctcctcccctttctgtcttgctcctgctcccaccacaggagatgccttgctcccccttgccttctgccgtgatagtaactttccagaggtctccctagaaaccaaacagatgtcagcattatgcttgctgtacagcctatggaaccataagccagttaaacctattttctttttaaattatccagtatcaggtatttctttatagcaatgcaagaaccgactaatagaccatttcatacagtactcaccacaaatattaaaaagatatacattattacaatttgcagatgaggaaactgatgttcaggtaggtaagccaatgtctcaaagtaagtatgtaccaaaaaagaaatctgaatccaggtctatcaaccacaaatgctcaagttacttcctctagagcaaatttacattttcatttactaatataacactacaaatataccatacatttttttgtgtaaataaatatatttataaacaagcatatctaactataagaataataaatcctaactctctcaacttctgtatgaaaaggttccctcctggagcttcccaggtggtattttttgctattagcaaacagaaaattggttcatcaaagctagatttgactctaaagtggtctctgcttccgcaaatctccctactactagccaaccaaagcataatgctgatgacattttaaaaaatgacaaagagtgaaaaggtgcagaatataagatgtcatcagcatgaagaaagagtataaaaattactgtcttaattactgtgtattttgcaaagagcagctgaaacagacaactacaagttgaggaaaaacacagtcaagtagtcagtaaaataatactaagaaatatatcctgcatactagtcaatgtattcactttgatacttttaatagtcacacattgatatttttacttaccctctcacctaattcttgtaacactcaatttactaaaaattaaaaagtgggtttagaattacaaatgaatttttatatcaccataagatttggtgttagcatataaggtctaaaatatttgtacctgaaatgtaattacataatatttaatggcatacttttaaaaaataattttaaatgaaatatgttggtataccatgtgattaacttaattttccatgcttttactttaattcagaaaatcttgcttttaaatttagttacaatcagtgtcatcatggctatttagttacttgttttgttgacttctctttactctagctttctatttacttttggtatcagttatcccagcaggaagccctttataacccagctgtgggccacaaatacggctccaagggagcctgaaagcagttaaactactgctatagatcagtcttttccaagggagaacgtgataaatcaatcttgaagcaactcaaatagttctctctgtgtaatcaacttttgctctacattcgcaagtaatatattgttagtccacttatttttaaaaaagaaaattatatatcctccccattttatttgactgtatatctttaaaagtatataaataagaactataattttagtataatagtaaataaatttattttcttttaataagagagatcaatgtgcataatatcaagtataatcaagatattaaacgtttttttaaatctttttctttgtgaacaagtaaattgaaatgaaaagctgagtagatttaactttttcttgagttaaatgtggttgaactttttctcaaaggcccctgtttataaatgcattattaatctgtcatgaaagttgcttaaatgttttagtttccacattaccaaactgactagcatcaacataattaagtaaatttcctatcaaaccacacaatagatgttttatattctttgaaataaaaatattttgatgaatttaatttgctcaacaagtagccttgaatcttacatcttctaaaggaatgtaaagctgttggaggatacggctccatggctctctcagccatagctatgaattatggtacaattgcctgtctttctaaattcacaaagcttgcaacatggccaagcaatgcttttgtagctagaccttggcttttcttgtcatgctgtttttactgtgagtcaacagagcatggctcaagataatttataatcatcaatgaaatatccttgacattttcagaatactgtgaaaagaaacaaaatcaagtaggccatataaagcccctacaccagagaatcccatgatctaaatttctacaacgttctcttcatgcttatcctgtgggcagtttgatgaaaatggcttataatgtgattttattgatatgtggatcaaaattattcatgtctttttccaccatatccatgtattccaccatttcccattgccaccacaaataaagacttgtgagacagaagaaacttcgaggattaaaatccaggttattaaatttatgaatcagaacgtcagagaaaaccttgtaaaaatagagacaattctgggaagcctcaggatcaacatctatgatactaaaataacagaaacaccaatactctttgtcaggtcattccattccctcctagccaaagaagcaggcttacgttatcttgaatatatgatctagtcattttcagcataggactttgaaaaaagaatttagcaatagggccacacagatagtttaaatttattacaactttcattctgtaatctaccctctcctgagtgtaactaatgctctttgtttcaaaacccaaaatgctcagaacataaatacctcagattttcaaataaaagtatgaaaagataaaatgtattagatttcaccaattgttgagttctaaggtaacaaactccaacatttatagaaacactaagattgcagtaatgatttcaggacatttctagagcttaaaagtcatgctgaataaacatatatgtttacatatatatattcagcatagctgaatatatatacacatacaaatgtttacatatgaaaacatgttttcagcatgctgaatatatgtaaacatatctattttgataaactggatatttatcagaatgaataaattggatattcatttgagaaattatattcttgctttgtacaaacatatgtaaactatatatataatgtttataatatatgtttccatatatttgcataaagcaagaatacaatttatcaaaatggatatttttattctgtactgccctccttacttaatagttcatatgtattcactttgcaaagctttaaaattatgttccaatagggaattagcacttttgctaacacaatcagtctcaatgaaatgtattggcaatgtgtatgtgaaatgtgtttgataatgacaggttgctatataccttgcagattccactacaaagcaaacaggggaaatggaaaccaagttaaaaaaaaaaagaaagtaaatttgattgccaataaaagttgagttatgtttgtttagctcacatgggaatatcagtttgtaaacaatgtgacattactcattgtcctttatttaagcctgagtctactcaaaagcctcagtgaagtcttaggtgaataatttcaattaagtatcaaaataacttgtgctactggaaacaatattagtcctattttattgatgaggaaactgtggcttagaggttaaataattggctgaaagttacacaatggaaaaatgactaaatttctgtcatcttggctggaggtcctacttattagaatatgttacttctacacatgatagttttgatacttacttcatggctcaaaaaataagatagactttatgttaaacagcaaatatcctatttaatagagtcagatgcacagtaaattctatgttgtataatcaatatatctcatgtgcaaatggtaactttagggtatctgtttaaatatcagagtattttctgctctctgtattgctgtactggtttacatcatattttcttttcttcatattttctaataacttaagaccagaatttagaatagctagcaggtatctaggggataatcagatgctgcatatattttcaggaacacttatgttgacattgcctattttggctttgaagtacaagctaattgtactacctgcagctttctactttttcctaataacttctagctaaaagtatgaaacaaaataaatcccagtaagaaagcaaaaatggtaatcatcaaattgcaagacaaaccatgacttaatcctttttaccctaagtcttatcaactgcttgaatgctaaaaaaactgactggaatgtttgaaaggaagcacactttgtaagatatttgagactattcatcaagtttccaagctacctcagcatcttctccttttaatcttccctatattccatcaaatcactagcttattcagagattcaggaatccgtccatatccatatttttcaaaaggtgaaagaagaaaaactaaccaaacacatgagatcctaaaataaaaggaataatacccattattcttcagtctcagataaattacagatctgttcttcaaaatggtgatgagagatctccccaaaaagtgaaagaaaataaaagataaaggggttcagaatctgatgttatgaaccgatataagttgacaaggaagttgccagaaaacagagaaaaaaatcaggtgaaaataagaatggagaagaaagacatgtacacagccaaagcacagatgcatatgaaaaggacattattagtgacaggctttaggaaatcatgcaaaatgaaatgttaaaaaaaagactgtaataaagagaaaataccagttatagaaaacagaaaatgtagctcaattaacgtgatgttcctgatgaagagagaacatacacacactctcaaaaatatgcagaaacattatatctctgaaataaaattaaaactttaatataaagacaccaaacaatcaaaaataagatgtacaagatgtattattcctacttcaatctcaagaatgaagaatgtatcattcggaaaccagtgggaaaaaaatcagttcaatataggaggagtctatgaactggaaacagactgatttcagacttcctactagcctctatgaatgacaaaagacagtgaagcaatgtcccaaaattttgaggaaaataatacataattagccagggcaaccttcaagtccaaaatgaaaaggccagatattcttaatcatacaacaactcagattagagcattctaccacctccttggtcaacatacttaacaaaatccaatcaaattatgaaattaaaaagaaaaaaattaaaaaagaaataaagtaatgaaggggctatcataaaagtattgctgataaaatttaatccatcaaaatataaaatcagtattaaatactgtcagaatttttattattatagaacataagacaaaccttaatgtaaaagtaataatttaataagatttgggagatatgtggaaggtgagaagaaatgctccattacctaggctggagtgctgtagcacaatcactgctcacgcctcccaagtagctgggactacaggtgtgtgccaccatgcccagataattttttaattgtagaccttgtagagacaaggtctccttacgtggcccaggctaatcttgaaatcctgggctcaagtgatcctcatgccttggcctcccaagtgctgggattatgggcagaagccaccacacctggcattttctactattttataaaattgtttcttaattccaagaaaaaaatctcatcattctcttctatttaactgactaaaaatcttatttgcctatgtgtatgctgggtcactattgtagggaaaaaatatcttttcatcccattttaggttccatagctgagactcctataataagagtttaacaatagaaaagctatacatttacttaatatatgttttatgtgacacgagagccttcataaggaaatgaagacccaaagaaacagggcaccttgtgtattttttatgctaggtttgatgggcaagtagatagttgtggaaaagtctgattggattaaaaaagcttcatctgatggagataagctgggggaaactcagcaagacctgtttgttgagatttttctttgtatccctgtatcttcagagatgaggatgttcctttccttcctttctctgagggttttatggcttcaggaaagaaagacatgagggaaggtcaaagagacctccctgcccccatggttttctttgattccttcagcttaaaatattttggggtagcatgtactgaacctcattattagaattctataaaacaattttgtggataccaaagaatagtggagtggattccgattcataatttgattaataatctcaagattatgctgcctgcaggatatgaatgttttctggggaaaaatgttgttagtggagatgaagagaaatgaatgcttgcttggtaaattttggagttggaattgacaaaatttgcagattaactacatgtggagttatggcagagaaaggaattaagattactcctgaatttgagctatattaactggaggagaaagtgatcctttgagatgcaaaacttaacagaagatcaggatgctgatggagaaaagtaatagaaataatagttcacttgcgaatgttagtcttgacatgccagtgagacaggtaaatgaaaacagcaagcatgtcatcggataaatgagcctaaagctcagaaaagaggtttgggtgttattacatgtaaatccaacaatatggatcaagtgtccttggaggaatatgggcattaaagatgagagggcaaagactgtgccctaaatttagacaacattaaagacacagaggtactgtaaaggaaaaggtaccaataaagactgaaaaggaatgggtagtgaaaagtaggaaatcagggaaagtgaggtttcctgataactaaagaagtgtttgaagaaaggaaatacagtaagtggtgcactaaaatgatgaaaagacatgaagtgtgaagataaatagaacatgctcattcgatttgatgacatagaggtagttgttaactacaaagaagagcttcaccatagatgaaatttaaagtcaaattggagtgggctggccagtgagtaaaggtgaaaatgtgaaaaatgcagaggtccacataacttttggaggtttgcagtataaaacagcaaagaaatgtggcagagctagaaggggtaatagacttttttttttctttaatgttggaagatactggagctagtatgtatgtggatgaaaagataaagtgaaaaaactttttgattaacgaaagagaagatagcataagaaagaaatccacggctaggctggtttggaaggttgtaagttgatgagactatccacagaaggcatgagctttaaaggaggaggtcattttgcacagcaggggagagctggtcattcctttcaattcctatagcatttctttaatatgtaaacaaatccagtacagacatccagctacaaacttcttaagaacttgaagaaaaatgtagatgaatattctttagtatttcttcttttttaagagactttaagtttaaatgacagatctctcaaaagcatcttctttctacttagagacatcttttctgactaagcttctggttgcaatatccactctctcaaccccaatccagacccttttcagtactctggacaaatattatctctccattgaaaccagtctactaagccctcagtccccggggtcagctttcctgggtagctcccaatgtcaaaatgtattccactagtgactgcaccccatgcctatattaatcatctgtgccttgtactttgcttccttattttaaagcttcaattttcactgtagtgtcagccctttaggaagaaaactctcaggccaggccttcgagtcctggaacatttcctctttcccacagtaatattaacatagccattaatatatctataactccaccaaattgaaattattccagcatctgatgttattcttcatacaaaaattatctctgggaatacagtgatttccctagggttctgttctgaaggattgacaataaatggaaatatatattagtctccacattttccaacttctttgaagaaatacatctgaagggagatagtacctctatattaaaattatcatttttaaagactttccaaaattttaggcatatttgtataaattatctcatttaatttaaaaacaactttttggagacatgaaagtatatagcaataggtcccctctaggctaaacctgaatgataacaatatatgtttggagatggcaagttatcaggaatgtcttttcatgcattcagttcctggaggtcaattgattatcatttcctaaagaaggagaaatacatggacaagaatgcatacagacattgagaagatgagggtaaagtaagaaataaagacacacaaagaaaggcacttctgcctttagagagagaatgattaaataaatgatgaatgagccgttttcttcagaactttgtgacacaggtagtatgagaaagagcttcaggtctcttattaaaaaccttttgggttggaaataggggcactcaccccatttttgcatagagcacattgaatccagctcaaagacttcacactttgggatgttgcaatggcaaacatagtacaacagtaataggagctggcagatgctcactagactaggcaaatatccatcaagagactgtgccaacttgcttgtgaacacctgagacaaaccctggggtttctagaaatatcatccttggaagagagatagtactcatagaagcagagaaagacaattatcaagcatcttgcagtaataattatgctgctggagatcacagagccaagagtttttagattaaaaaaattaatattcaaataggctattattttgctaaaagtgcacagcaagttgttggcagacctaaaatctgaagtagatttgcacaactccaagactgaggcgccatgactataccaaagctgtgtacagatatattcagacatgtaaaagtgcagttcaaattttcattatctccacagtaatattgtcaataatgcttacaagcaaaaacagatatcctaatactacaagtaattattttttaattaaaaaattgtatataggccactctggcatatattggactagactatggttttcttagtaatgcattagccacggttttatccccaagaagtttatattttagcagttaaaagtgaagaaaggaaaactacacagtgagctatacttgaattaaacatatattgggcattggggagcatataaaacagaaataacattgttagacaaaaaatctaacattggttgatcaaaaatatgaagaaattggagaaagaagaaatttctaggcagagattatcaaaaggtctgaaagtgaagaaaagaatactgttctagggaaatgtccagtcatttactctgctttgagcttagaatttcaggacaggagtaatagctgctggagagattatgcaatacaaaatttaggaaaggctagatggggccaggtcataaagggcttagtataccctaaatatatgctattaataaatggagagtcactgaagatttttgaacaaggatatgaaatggatggaaatacgtatatggagtaaatcttcttagattatgcattaaatgaaaattgcagtaatttgtaatgcttatgtatttttttcttaatttttttattttgcagttcagaaatacagtacactcccattttaatgcaaataagcagtatacaacaattttaataaaatgtagctcaagttacggagaggctaatgaaattggagttcaaaaaccctcttttgacagctgcaattcggtaccagctggtggcagtaatctactccagactaaacatcaatgaggatgattcagctctgcatggctgaaatttttaggacattggcagcaatcccaggaatctcccaataatttagcactattttcatcatctcaatcccaggatattgaagcagcggattggtcctgaaaatatagagaaccaccttctacctccccatttcctaagccaagggtgtttgtcctcttttaacttttccctcctttcctgagaggagagggaaggaagagaaagaaggaaatttacccagcctcatttatatctacatgtactttatcacaggacatatcatcatgatgtctgactgcaggggcttccactgtactatcacgtactattgtcattttggctttaatagaaatggaaagtgaggtcagtaaaatcattagaaaatattaaaaattgttaactgtgaaaccagtgtttttgactaggtaattaatgattaaatattttgcttcttttcaatataaaaaacaaaagagataggttatcacccagcataactaacaatttaaagcccatggttaatattttttatgctggtgttgtaatactcttaccatggcatttatacgtatgcatgaacaacaacagtaaggcacacaaatacgcctgactcctttacattacattggttttccagaattttggagtaaatgagctttgcattatggcttttaatctatctttatgatgaagataaagtctcaagactcttaaaaagccgtaacaaaaaattgtttccctacatagcagaaatgttgcaaaaacattaaaatatgcaagctcttgatttcaagagtgtttcaaccaaaggtggaaactaagaaagactaaataaagccagagcctaaaatcattttggtgatctattaaaattcacttatttattcattaagacaatgctacgctctcactttttatccctaaaagtcagttctttcaatatccaagacctcataccaagtgactgtctgtcttcgattctaagtaaaacaaatacagtgtgttttcccattccacatattcaaaaatgtttctgctacaatcaataaaaacgatgcaatttcatgaaatgaataaggatagatgaaatgattaaatacataatgccggtgcctattagtttaactcgcataaacacaaaatttaaaatatcaacatttcaaaatatgatttggcaaagtaattttaatattataaaattaaagctataactggagaactaaattagcctgacggacactcaataacgtacaacttcactagaaacattttcaccttctaatttactttgtgaagctgaagctaaaagggactcttcaaatgttttatttaccggccaatttctagacgtctgtactctgcctgcacagtaacaagctggtgctaataagccatacataaagatcctacttattaaaatacaaattagacaccccttatgtttatacatgtgtaagtacaattaatattgcaagcttccttggaaacaaaattgctttagttaaccaaccattgcaatgcaatcaaatgagatttgaaatgcaattggaaaagatctgtttggtagaaatagcaattatttcatgcagaacaattagctttccaagctcttttttgcttctcccacctgcccttaatagaataatttgtccatcataagtgacatgaaatgtcacctttaacacccataaattgtatggagacctagcaggcagctggtagacatagcttatttacaaatattagtttgaacttgtaaatgcatgaccacataaatcttaatccatttagggtgtacgccctttgttccctcaattgtgtattcagttgggaattgaatggagctgagagagagtgtgaattgcataagtcctttgttgttgccagcatattagtgctttgccttttgttcttgttgttcatgagatttctctacattacacagtagggaaggttaatcaacattttgcctaagtaatattaatgaaacttgcctacttacacttgagggaagaatcagaatattacattgctctttgaaatgttaatgtaccttttaggaaattatgtctgccttctaaatcatcttagtgttaaattattaaaggatggcattaaagaaatattgcacagatgcacattgttaaataccttaaaagataaaagaattataaagtttaaaagaaggaccttttgaaagatgataaaatttatcttcaaattaaccatttttaaatgtttggttaaaatattgagaaaatttacaattgttttgtgtgctttcacaaaacaagagatttaatgttaatgatttataagtttcaaccacgaatttgaactgtattctgctctggtcttgaaggatttatttaaccttgctgtatctgtgcactaaagcaccacctagtttattaggaacaaaaaaaaagctgagaggaatgtattatttttgtactttttacttatttgagtcttaagattagatagtcttcattgaggttctattctccaagcacaaaaacgaccactatctaaaccttctatcactctatggcatttcaaagggaagggctatcataaagactatgtatggctgccaaggttagatatgggaaatagcaattctcaatgtgcaaactgtgacagacctgtgtcctgtcaacatcattcacggtccttcaggaaggatgctcaggaaatgagttgacaggactctaagtggtctaacttgttttccctttaacagtctcttttgatgtcaatcagtatgtcaacaggccctaaataaattgtgaggtaaccaagggggaaattaggaacagaatttcttcaagaattctcccacatggtgaccaccatttgctaagaattcctaatacttactgggcaaataattcattttctatttcaccatagaagatttagtaatggcttttgtattattgtgggactgatttgtcctcttgcacaatgtttttttagcagtactgctacttggatagaggcaccaaaaaagtagaaaataagggttacatttcaagataatttttttcactttttgacatctctaagaatacagcatacaattgctgatgcatcataatttaagtggcttttttggtgggggcttgggggagatgaggtctctctctgttgcccaggctggagtagtacagtgtcatgatcttggctcactgcaccctccacctcccaggttcaagtgattctcctgcctcagcctaccaagtagctgggattacaggcatgcaccaccacgcacagctaatttttgtatttttagtggagatagggtttctccatgttgacaaggctggttttgaacttctggcctaaagtaatccacccaccttggcctcccaaagtgctgggattacaggtgtaagccaccatgcccggccaagtggctttttcttagaaataactaaaataaatagaatgactaagtgccttacaattgatgatttacattcaataaaatatggtaatagcaaacttgaatttagagtttttgtattgtgtttgtgttgtggttacccattacctcaatatagaaaacaaaataattgccaaatgttagtgttaatgagcccaatattaaagagttcacaatgtctaggaaatgaaaccttatgtctagaaattaataaataatagttaaatgaaacaacaatgatataggcattactacaaccctacttgccaagttatttttttccacattattgctctttagaaaagtgaaaacaacatacaactaataaatgactacttaaaatactaccaaatgaatttaaggcaaagaaaaagggtgctttgaacagggaatgtataatctatatatttcagaggctgagtttgtgtgtctgttttgagttctccgaattactgaagattcaaactaaaacagcaccaagggtattatatctatgctaggcagaatacatgatctagccatacatctattatgactttacactgcttttaccatgcacgctttatgttgtgggacataagggaagagtaatttatatttaatgttgttaatcaaacatatatttagctagatttgttttgctgctttttccctatttgcaaaaacaaaaaaaatcgtttttatctaaaagcaactaagtatattgtaagcctcttcattcactagatgagcttacagtttgctcgatgctctaggagcttatgtttttagcttaatcattgattttttccttaatatatcatggatagcaaattgatctttattaacctgtgtatgataaaggttgtagacaaagccaatacctacataatattaataccaatcaagttaagtgatatgatcagttcagtagagaatcaaacaaactggcagttgtcaaatagagtctctcattagtagactgtttaaaatatataaataagtgataaacagtaaaaataaataatatcacaagtatcaagaatggaagactattatatacatgaattaaatatcatttagtgcattttcctttgatattcaacataatcatagaaacacaaagaagtgctaattcttaaacctcagtttagtgtctactgaagcacaactacataccttcaaatttgagacttttgctttgcaaagagtacaattaagctgtcgctcacattctaaacctattttaaatgtgggaaggtagagggcagttgtttacatccccaaaatgagttgtctggaagttttctgtgatcagaaattataaagattttctttcactacaactgtaatcactcaagtatgtaacagaagtactttctgattattaaggaatttttttttttttactgtgccccttggctataagaggatagataaatgatagatatgcagaccttaccacaaggagaatttctgctatttctataaactagtaactcttagttcataaaacaagtttattaagaaaaaaaaaacatgcaaccgctaatgtcagctgacatttctcaaagtaggccagagtagaagagagattacttctagctaaagtgaagcaaattaaattttaagaagttgaatatattcattctcactttcatcatattgcccaccatcaaggtgattataatatgtatactgcttcttacaaactcaaagtagttaaaagcaactttttccaacttgtatattcataatatcgacaaaaattattcagatattaaaatttaatgctatttttaatgtattttataaataatgtacctttaattatgggagaacatttcaagggttttaaagggttttttggtttttgtttttttttggtaatatggaacataaagtacattttggctaacttaattggccctgattacccaaaagcaatttatttaaaaagcaacaagtatgattatttttaatcccacaacatcataagattccatcattaaaatatattttaatatgcatgtaattatccatacacaatatgtcaagctatttaaatcaagtagttaaaaggggttcttactgcaaaatcttctctccactggtgagctgcttgaactttctccgcttccaatgccaggcgctgaaaaacaaacaataaatcttagaattcaaatgaacacgtaatatggaattgttatataaaatgcttgcgctttctaatcaattttgaggacataaaaagcagaagatgatccttatttatgattcataaattctaaatcatttagtaatctaacctactaaagttgatgtttgtatatttactcttcagcaatataaataatatactattcttgaataccattaagtttgttacctctgccatcatcagctatagtgtcctctatgagtgctttctttcaatgactaatacttcagtttttagaaaaacacttaagtatactaattttcatagaatcttatttttagtaaatacctttggagcatacatttctcttaaaaaatgacattgagagattaatatgcactaaacaatatactaggcaccttcttaaatgcatattgagtttttaccaaaagccacaaaagctgaaataacttcccctttgatgaagtacatctttagtagttctttcagcgataatctttgatagaggatttgtgcatcttaaaattgctttatttcaccttcaatcgtgtatgctaaagtagttaagaattataagccaatttattttcctatagcactttcgaaatgctattccattaagttcagtgggagatgacattgctagtgtcagcctgccaatcactttttataaacttttttttcccctattccaatagcttttagacttttctctttgtatttttcaacttcactatgatgttctccatgtgataggctttcataagacagtgacatttaatggttaggaacacagagttggggacccgactgcctagatttgaatatcagcccttgcaaactactagctgtgcaaccttgggaaaagttaagactcttctcccattctctcatgtgagtaatgtgaaagcctgcctcatggcttattggaaggactaaatgagttacaaagtgcttagaacagtgcctggcacaaactaaacaatatatatgtcaactatcaacttcaaagagtaatggttctgttttctccctggatcccctagagaaaatagtgcagtgttgagtttatttgtggtttgccttatgcagctagaagatagtgataaaactgagcaaacagaaaagtaaatataataaatatactaaactcacttattaaggtatagaaattatcaggttaggtttaaaaaattacaaatctcagagtcatttattgattcatgctgtttgtgatctatgaactattccttagcgtaagttcttcctgtggaggtccagtctacactggataaacatccttctagaccagtttttatattaatgtattggcttctatccctgtgattataatctattcatttttctaagctgttgcataggttttatcagtgactctataatattgcctagtgggagatctcaatttaagagtcccaaagctaaatttaagtgaaaatctatcatagtgtgccaaaaggacaatggttttgtttttcactactaggtagaaatggagtatataagaagctaggaaatgttagaaattgtaccacatagagtaaccaaaaggcggctccctctccctacaaaaacaaaaaactaagcagcaaagccaaaagacaagcatatacatttcaggaacactgcatcataatacttttagaaactcaacttcacatgaaaaatgaagcaaaacatgaataaaatggcaaaaggaatggaaatggaagcaactcttctatagaaacacttcagtatgggaagataaggaaagagaagatagaatgagaaaataagcatgaaggctttttctttttttctttgttttgatatagggtctcactctgtctcccagcctggagtacagtggtgcaatcatagctccctgcagccttgacctcctgggctcaagtgatcctcccacttcagcctcctaagtagctgggactacaggtttgcatcaagaaacccggcttttttttttttttttttttttttggtaaagatggggtctcaaactcctagcctcaaattatcctcctatctcagcctcccaaagtgctggtattacacacatgagccatcctgcccggccaaagacatgcccttgacaaaatttgcaatgtaaatcttcccccatttaaaaaaaaaaaaaagcagtataataatagtaactaaacttttacatgtatgggcaaaaaaaaaattctggaacttaaacaaaattctgaataaaatactaaacctttttagattaagaaacattagaactctaagatgtctttgtgtcttagagaagaatattaagttttttcttcagaatacacaggaagatgctgtttcagcaaacaaaacacactagtgagcattcacccacagggctatgcagtttccaaggtaccagctgttaactctaccagatctttcctccttgggagtgcatgagaaagtgcaattcaactgatctgacccagaatcacgtggcttatgacatgaacataatccatgtttagtaagttatagtgacagtaatcatcacagttaactatttccagagaaacagaataacagtggcaacaaactataacacaattccctaggaggaagatagtccaaatcggctttatttatatgtattttgaacactaattttataaagtaaatgccctgtattgcaagactctgaaaatgtttttagaaaaataaaggcatgaagttatgtataccaaagaagttatgtattttaaaaggctggtctgaagcttgaaagttgctaaatttcatatccccaggttggaattttagaaatatataatcatgaaaactctactcctgttaatttctttgttcatgaagaaattaataaatatttttacctagcaaatttcatgacaaagcatataatactaaactttagagacttagtctatctcgggactagagtcaacagtcactgggtggtgctacaaaccagccggtcattacttatagaaaaccgacatgtcttctagacactttaagcctttaattcacttctgttttggtcaaatgacattttatttttaaagctaatgagctaccattaaatggcaccggtgaattgtgttaaggctgtcaaaggccaggcacatggctcatgcctgtaatcccaatactttgggaaggggaggtggggaaaatctcttgaggccaggagttcaagaccagcctgggcagcatagtgagatcctgtctctaaaaaaataacacaattagccaggcatggtggcacatgcctatcatcccagctactcagggggctgaggcaggagggtcacttgaatccaggagttcaaagttacagtgatctatgatggtaccactgcactgcagcctgagctatagtgcaagaccctgtctcaaaaaaaaaaaaaaaaaaaaaaaaaagacacaaaatacccaataaaatgtgagtatctgctcaacagaacatccctgtttccatagttggctatataagtatatcctgtaacaataacttacttcagaaaaaaaaaaataaaaaacagaacacttttctgatttatggcacagcataatatagtatcagaccttaaaaccagactgagcaccacacagaaataaaaaacctggattacaatgaatacctatgagaaaaatttgaagcttaattctgctaatattacgatattcagcaaggtttattaaatggctttattgtaactgagataccacatgtatatatgaaaatcctttggatatcaaataagtatttataaaaagtaatagatgtgttaagaatgtatacatccctacctacttattggtttgaacatttaaaatagaaaatcactataaaggttttaaggacttacaactataacaaaatagacttgaccccagactttctgactccaaagcttatgctccttccacaagaccattctttagattcctataaaactcatcagagtatatatgaagacagagtaatatcaaaaccaaaacactagaattcaattttaggttaataaaaaaatccccagcaaggttttagaaattactaaaaaatgaaaaacaaagccagcagcaacaacaaaaatcatattttagttgggaaccatctttacaggtcttgtcctcaaatcctgggagattattgctaatcagtaaaaacgcttttgctatgcagtggtctgcagggagaaggatagagaatgaagaggttttatcagatcacagaaagatcagctcccttgaaagtctattcattctcaacctttactttttgtcatatcttcatcttttccattagcgttgaattctgtcaggtgatataaacttctataaaagcagtattatacagtatataaagatataattctactatcctaatcaatatccacatatatttttccaaaaaaaagactattttccaaacatgtaagtaacttgcttcctagattgcaaatttattgcaagttaaagataaaatttgctttctgaaattatgagaaattttcttttgatagctttaaaaaaaaatcatcagggatcatataacagttcagttacactcccataatgttggtactcttgtttatatacaaagatttgacttacagacaccatttaaacaaatatcactaaatttcaaaacaatttcttcagctaatgtaagtcaagattttcctttttaataaaaggtaatagagatctacaacagctaatccaaataaaatatgcatgtgttatgtgattaatcttcaaacagttaacacccaataaagattagcaaattcttgtattatacctatgttgacaattcaattatcactctaggagtttcacctactatcttcatcaaacggttcttagcatatcaaaaggatcaggataatcatttgaattttctaacaatacctactgaaaatagcagacttaggtgaataaacagacttcaatgttcgaaagaaaagcctacagatacaatcaattactttggatctatggtacaatgaacatgcactggtaaatcagacagatctggtttccaattctggtgctgcttttcactaacaacaaaattttggtaataaagctaacaattttgcatctaggattttcttaaccttacattttctacttggcattctacatatctagcataatacaaactcagtaaagttttgcttccgtttgaacctgacaaacatgaacccgtagaataggctatgtcagaactataatcaccaatgacctcttcaacacgtacatatgagcgaaataaatgaaaaaaaatcttagtagaccttaagttttcactgtattttaccctgcaggaaagctctggtctataaaaccatagggtaaccaaaagcatatgcaattcagggaatacaacagctcagttcagtaaaataagttcaattttattttatttttaccacaaatagaataagaaagcagagaagatcattgtgttctgcctgtgacaccttattttttctgaagggcagagaagggtataggcaaggtgtgacatttcttcagcatttcttatgctgataggaagtcttgaagacctcaacagacataacagcataatacttccatgaatattgagtataatattccatctcaaaggtaaaatgttctttttccaataaccttaactagataatgggaaacaatgcagctgaaattcatataaacatgtatgttcagcagaattctaccaaaggcttctaacaatttgttatatcctagtgaacaaggattttactaggaaaatcttcatgtgcagagaaattgctctgtatgtttaaatcacatgtgctgtacttacagattgttaaaaatgtttctataaagaaatattattagtactctgaaaaggttctgttagctaaagaagccaggctggaaactgggatttgaggattaaaagttataaaatgtaaacagactaaccaggatgagttaactttggtacatttcaacatttgataattgtagcaactagataaataccctgactagggggaaaagttatttctaggacaagaagcctagtgtgtttgcttctattcaataaatatttactaaggctcgttatatgcaagttcacagaataaaaaatataagacatagttttatcaactatgcttctaaagggaccttatattcatataccatatacatcatatacactcacacataatatcatgtggtgttttacagatgctttctcaatagttaaactatacatgctttattcattttactttatttcagtggcctctgccacatggagaatacatttttaaagtactgcttctatcatgatgcaaatatctcaaaggacaggaaggatcctaaaaatagtgtcattagccaatgacaagatttagctacaggtctctatttttttttttttttttttggcgggggttggggggcgggctggagggtattggggaagctgaaaatactgaaaagcacagaaatagtctcgagcctaccaccccagaattcaccttgatctttatatttgctttataactttatgtaagaaaaaaaagtattacaaatcaccttgaagttcaccttattcacctcttctgaccaatttccctacacagagcaatcaccataataaattgatctataaccttaggcattggttggaagtgtatttttaaaaaatatgtaaatatcatctgatattggtattgttgattctccttgctaataggctacatgcaaagagaaattccacaagtttcatgaggaatgatttatctaagaagaaacccatcaccctttcaaggtttggattgaacaaacaaattacaatcaatggtgtatgagaaattatttgctgaaggttttggaaagttaagataatatctggaggaggacaaaacccctcagggaaactaagctggagccatttctaagatttttttcagcatcaaaatgttatacatcaattgcatatttactaacagaatgtagaataggtattatttcttaatacaaacctacctattccttcactccatcaagagaccatcaatctttcttcacaggcactcatgatgcaatttgaaagattctaaatcataacttaagcaaggcaacttaaccaaagacatgttgatcccctctcattattgtgctataggttagcaagcccacccttataaagatgactaaacactgtttatatgttttacttatgcttgctaaaaaatttttgcagccacattacagataaatcttataatgtacaaggtataatgtaaggatacagattaactctttttgatagctatcattttcttacaactgatttcatgccagattatgggaaataaaaatctcataatacaaatacaatttctctttctagcctaagctttaagggagtgtaatatatgcaaaacatataaataaaacttgctgaaataaagccagtcatttatttttcgatctgtggccaagtgaaaaataaaactttcgcctcatagcttctggagtgtgtcctatagatttcaacctgatctgccatattcatgaaatacttcaaaattaaccacaaagcttcaaatctaatcttcagagatgtaattatttccaaataaattggaagacccttgaaatacagaaggcagggtaagggagatatcatctggtgagaacaaaactccttttagcagtatgaaaataaataatacacaacaattatcataccttcttttgggtctacagcgcaaaataaaaggttgtccaaatgaatataatttgcagctctacgttttgccacctgcaatgaattacgtgttgaacttgttgaacacacctggaccccatgaaaacccctccaatcccaccatcatccaaagattctgattctatagctggtgtcattcctgaaaatctacgtttaatatattacaccttttccatagataaaccttgaaaacactcttctagagggtaatattttggagctattagacatatggattgagttactttttaagaagcactgttctaaatagcaatataattatcctgagacaacaaaacagtccatgcccttcactagttctataacctcatgctatcatggcccatcatgctatactcaattcgccctccctctaaatcactaaatgtgcgttcatccagtgcaggaagcagttctttcacatctgcgcacctccagtatcttatacaacgtgcagaacagtgtaggcattcagtaagtgtgtatggaaatgtggaaacaatcatttccaagcattttcaaggttgtatcaacatctataactaggttcaccaagtcatcgtcattcagtattataatactttgacattctgtgactttctggccacaaaagctgtcctcctacacgacaagcatacatcaccacctaattcttaaaaattgctagattaactcaacactacctgtcacttaaaaagtagtagaatatggctagggaagtggcaaggatacaccctaatccatgtaattccactctggggtcttagaattttagattctaaaattctaagaccttattcagttaccttattctctacatgttgactgctgcagattcaaaaacccaggaaggaatcactgtggagaagggagagaaaatggactgtggagaggaaaaaaacaaacagaaaagaggaccattcctaatactatagtcctgctgataatctagtctaaaatcccacaaaattaagtcacaacatcaaactatttacattaggagatcatccactcagagaatgcaaatatctcttcagcttgagaactgcattctggtatgtcacactaattccaaaggccttcaatcactttgcataacaaccaaattgcctacaaataaacaccaacctaagttgccctaaaatggttgttttatgtcccatgtgaccgctcctttacatatctagcaattattttttactaccatgaataactaaggaagcataatatagtaaaaacagctctgccacttatgaccagcagcatattaataacttttaccacaatttctcaactataaaatgagaattttagtagtgcatatatcattttgtattataaggggtaagtatgatatgtgcttagtattcaataaacagaagctattatatattaaaaactaagggggagaagttagactcgtcataaagtcaataaactgaattcttaaaattatcaccaaaaaatattacatacacctgagagaaaaaaaaagccatcttaaattatttccataataaagttattggaaagggcataccttcgctgagactagaaacttcagaattgttttgaccatattagtcctctgaattagtcccaatttcaatcaccatattgagagaaatttctcctcgggtccctcatgtttctgcatgtcacatgaacagaggcaaagagagactagtttttcaagaatgcatagcaaacagccttggaatatagagatagtgtctccctccagagcgagggcagatttgtttcttgccccaaaaaataaaagtgatcctctgaggcaagtgcggtgtcctggcagacccctttagatgactggggtttcccaaactcagggttcatcagctgtaacacataccattgcatacaccataggcccttgggtcattcagcagcaacctcactgggtttgagagtccagagatactgatgcgaacacaaagctcacgctacctactgtgccatgaggcataaggtccactgtgtctgaatcagggtatctcctgcatctgtgaaattgtggtcggctagcttattaggttgcaattagggcaaaatctcagaccctttacatttcttgacacccatgttgtactttttgttgttacggtttctaatttggtcttgaaaactctattgagagtggccagaaagcaagaaagccactctctaggagagccctgatgaggcgctgggttgtgaggaggaattagtcctatgggacgggtaagatacaatgtggaggtgaaactaaaatgcataaaacagaagaaatgcattacttacagatcccagagaggttgcgggggtcaacaggaggccagtgggaagtcttgaggtgacagggagctcagctagcaggtggcaggtggggggaagagggacagagagaaatagagacagagacaggcagagacagtgaggaggatctctgggactatgcctttcttaaggtgctcaggctttctcgcaggtgttgcagattggctagtttgaagaaaacatgccagaagggggaacttatttatgtaactctggtgttggccattaggtttatcatggtcagcagctgtggggcatgtcggattttttttttttttttttttttttttttttttttttgcgtcagtgagatgagaaacaagaaggtcatatcaaaaacgactacgaggggaagagaagttttaaccaggccgaaagtaatggggtattactgggtttgaaacaacttatgtgaggcctagaaatggatgtcaaggcagtaaccatgttaaacaaatttatgacacaccatgtctggctgagccagcttgtcaaagtgttcactgatccatctctctggcttcagactctcactatcatttaactagtgtcatctttattttgtcttcagcaattctttggtgactctgcattttggaccttaagagtcacgatgtctttagaacagtacttctcaaagtgtgcccagacccgctggggcagcatcacctgcatcttgttagacatgcaaattctcaaatctctccctaggtctactgaatgagaaactactggagtgggccctgtgaatctatgggttaacaaacatccaggttattctaatgtgcattgaagtttgagaagcactgctctaaaagaaaacttcacagcatcgttcaaggaaaagttttagattatcttaaaaaagcaagctctcatatctgagggaaataaaacaacaactacaacttacgtgttctaaagctcttttgaaaaaataaaccttgtaaaggaaacagaagtcactggaatgatacccattcagaaatttaattgtaacttattcttttagtgattattgtaatttgatgaactttgtctctgagccaattaactttaatgtgaaaacagtaaaataaaaaggaaaaatgatatttgctttttagacaaaatatgtaaagtgacagcataatatattattacaatcaaatgtatattggaaatgttattaaatcctcaataaaatgtcctaaaatttattaatttgcattaacaaaatttcattttgtaattgtctaaaattatcttttctaatttttttctttgaaatgtactgtgtatagtctttataattctcctttcccttccttttttcctttctttcttggatggaggatgctcaaacttgcttgtccttgtgagcccattactcacaatttgcaggaatttgtgtaggcttcaggatttcattttattttagtattctggttgccaaatgcattaaagtttataaaaggtagaaggaagaaaactgctatactcataagaaaatgatcaaatctctgtaggaattaggtaaaagaattaaactacacaaccactttaaaaaggaaaaaatatggaaaggccccatctcactatcagattgttgcatataaggttctgtctttacaaaagtctacaaatatatcaaagttcatgtgggtctgattattctaccaaaataacaaaaacaaaatgtaactggacatgatctaaattgacataatgaacaaaaaactgtaaaatgtagtataatagggtaagaagtacctttgaaaattatttttggtacttttttctgcgttttttttttaattttaagaaggaataaaaggtaaatctaaaaatcaactcttcaaataatttaattggagataagaatacaaaaatttaatatacatctgacaaaagaacatactttacaaatcttttcattcacatatacatgaataagcttgcatatgcatatatgaaatgagatgaataaaaattgattgcccaggcacggtgggtcccacctataatcccagcactttgggaggatgaggagggcggatcacgaagtcgggagttcgagacctgtctggccaacatagtgaaaccccgtctctactaaaaatacagaaaattagccgggtatggtggtgtgctcctgtaatcccagctactcagaaggctgaggcaggagaatcacgtgaacctgggaggcggaagatgcagtaagcggagattgcaccattgcactccagcccgggcaatagtgtgagactccatcttaaaaaaaaaaaaaaaaagtgaggcgcaggaagggtagataaaatcaacaaaacttattttgacctccatagtgaaaactaacttaaaaggtttattttatcagtaaggaccatcacttttctcatatatttttcaacattttacaatccctagagtgtttatcattatattgaccttgtcataatccaagagttttaaaacagcctgaatgattaactttccaaatcacctggcagagagatatccattatcttacattgcccccaaactggtcttaaataggtatttaagatgggcagatactacacataaatttaaagaactagaaaatgcagtactgtcccaataatacatggtaactaaaaatatcatcaagttttcacttcagttattctgaatataattctcaatttggtttttatttttagttaaaattttgtacaattaagaatataagaaaccataaaacacatactgactttgaaaatatgggtagaggagagtttttaaaatttctctgaacttctggttcttcttctataaaatggagagaaatacccatttcacagaattttttaggaatttttataaaaaattgagaaaaacattgcaaaaagaagagatttttgcaaaacagagtagcgacatcttattcaacattagctattatgaatgaagaaggaggaaaaggaggacagggttcttttattttatggaaggtctaatcaaataggtatgtatgactgtggtcaacgtacgttacgctcccaagattgtgtcagattctatctggtgaaccacttccagtccttttaattttgcaataatgatttgtcatctccagctctgctcctcccaccacccacactctgactcttcttatatcaaaggggattcatttccagttatctcaacctattctttgactggtggtaaactatttatcattcctgacttgttatattaatttccttttacctttaaataatttacctttgagtttaattaacttgcacaggctgccaattcagtgagtaggatggttttaaaaaaaaaaaaatgaaaagtgtgatcttagacggtaggcaaattttctgttttgctaacgttgctgtggaaacatcggtttcctcttttttttttttttttttgttaatacatggagggggatggatgtatcacattctgtggcaaagagtgtactatatgcccctctcactttgtaatctttcctcctaggagttggaaaattactatgatgtgtaaatcaatcaatcaaatttgtaaaatataaatttacttggtttcttaaatggcagaaacatcatccactaataatctgaaaaaaatatgccacctctgttttcccctttttctagagaacatgatttttttaatgctgtaaaatattcagtagctctttagtttttattttaatttgagtaatactattattatttctcttcttcttaagtgagttttaatgatttcggtaaaagctccagtaactgacattatcaaagattctttcaataattctcatactattatcctgtaattttccactcacgttttttagatataaagcttctaagcagtgacaaattttaagctctcgagtctcaagtacaaagttcaagaagccttcttcttttcctttttaagaaaaattaaaattacattcattatacagtatacatcatgttattaagaataatgatggttaaaatgtgtatgttttacagtttatgaaatttcttttacatatggtatctcagttgaacatcataatgagaaataaagaagggctgatatattttcactacttactctttaccaagcactttacagaaattatctatatttcctacaaacttagtacatactcccattagttccattttacaaaggagtaaacagatgttatcgagcttgagctcccttaagtcaccagctaaatggtggaccagctggaatttaaatagaggctacctattccagagtccttgtctctaccctacctgatgaaagaagttatacaacttgctctcaacatcacgtaagtaggagacaaactatgaataggagtaatttcttctcattctacatacagtagagcatacctatggatatgtgtcaaataaccaattaagcatttgaaaaaagtctccctcagcctttatttaatttgtattcattttctaaattagtagcatccttttacatctggtattttttttgtcactaccccactgcattccaccacttcgctgcagcattcacagattggaacattaggccaaatggaggttagggctgtgtggcagaaagctatataaacattacccaccccgataactcaaaaggagcaatgttactatcaataagaaaaataaatatcaacaatggaacaaagggtcagacaaaaaagagagggggggagggggaggaggagggggaggggagggggagggggaggagggggaggaggaggagggggaggaaggggagggggaggagggggagggggaggagaagaaaagaccaaaagtgcagtgtaagggtaggaattcctcttcagaaactcaactaactgttagttcttctggagaatttcgtgatatctattattaaaaaggcaagcgaagggcaaggacagtgcttactttgaacatatagactgtattcactatgggaaagtttggaagagcagatgagatgttcttttaagagatttattaatatttatccagggtatctccatgcattcaagaaactaatttatactaaagaaagggaaaatacaggcaaacacatttgatttaaagaaatgggccacaccaggcatggtggctcacacctgtagtcccagcactttgggaggcctaggcaggcggatcacctgaggtcaggagttcaagaccagcctgaccaacatggtaaaaccccatctctactaataatacaaaaattagctgggcgtggtggtatacacctgtaatctcagctactgggaggctgaggcaggagaattgcttgaacccgggaggtggaggctgcagtgggacaagttcgcgccattgcactccaccctaggtgacaagagcgaaactctgtcaaaaaaacaaaaaaagagagagaaggaaggaaggaagggagggagggagggagggagggagggaaagagagagagagaaggaaggaaggaaggaaggaagaaaggaaggaaggaaggaaggaaggaaggaaggaaagaaaggtgggccagatttgaggaaggtgggcaaggttaattctgagtgaaacctcttaaatacgccccctgattgtctttatcccagacctcaaggactcttgaaagaaaacactagaagttatttcaccaaaatctttgtaaaggactaaaatcacaaggaaatgacacttcgatgtatgttacagagcaaagttaaggttgcagggtatttacttcctgccattggcattatgggggcatagaccatccatagaaggctcagaaacaccccagacctgacagaggtacgagggcgttaccatgtatacagatagtctcaaagaaatatttttaggtaaacagcttttaaaagtttattatacactattttatcacctagctaggtaacatagatggaacacgttaggacaaaagaaatagaaggtaagatttctggaaaagcaatctagtagcaattataatagcaaacatgtatagatctataatatatgatagtatgatatgtccaagaaaaaggcactgtggatttagacacagatttgaattctgaatgtggctttccactcattacatataatctctaagccataccttcttctaaaaaataacgataacaatgtaaaatattgaagctttaatgtcacaagaaacataaacataaaccatctgatgaaccataagactcattagtattcagtgactctagatctctaaacttcttttttccttccataatgcttgatccatttttaaggctgcaaatgataataaatgattttttaagatccatgtatctaaacctcacaaatatctggctttttaacaaatatcagtcatataaaatctggcatttgaattggcaaatactaaaagaaacaaacaaacgctattttcaactgaatatttatgaaatctgtgtctctaccttcagtcaatcccaaaggttgaaggtaagtaccacaataatccacataataaatacatttattactcatttgcagtttaaaactgtacagaaaaattttaaattggaatcctttcaagcaacacagaatcacaagcctaaaaacaatctaacctatagagtaggcatggaaaaaatgtaagctgatttaaattcaccaaaaagttaacaacagaaataaggacaatgtacaatagtatttattactccagcaacatctgtagataagatttgttagcattttcaattacaagatcacagaaggtcaaaaaataatcacatacatggataaacattgccaaaaaaaaagatattaatagtcaagatttctgaggaaacagctgatagccatcaatgaattagaattgatttaataaattaaatcagtcaacttggtttaatcaattaaatcagtcaatgcagatttattcatcacctactttctatatgtagagtttgactttaggagctgtgtagattgctttgataattgagagctaaatttgggctactgtaacagaaataccatagactgggtaacttaaacaacaagcatttatttctccagttctggagactgggaagtccaagatcaaggcattggcagaggcagtgtctggtgagggtctgctttctggttcataggcatacatatgtatgatagtaagatatatccaagaaagagatgttgtggacttagagacagacatgaattctaattgtagctcttccacttattatatctaatctctataccatattttctccttctataaaatagaagcctcagatgacagaattggtgagggagctctctggggtctctttataagagcactaatcacatttgtgaaggctctgccctcataaactaatcaccttccaaattccccactttctagtatcattgccttggggattaggtttcatcataggaattttgggggacataaacattcagcctctagcatgatttaatcagagaaaaatatcacaaagagaaatataaaatagaccaaagtatactaaagatttgtaaagaaggtaggaagcaaaaaaggaatttagcagtcagggagactgtaatatctggtaggtgagataatttaagcaaaataataaagtagtcatatttaaggcatattttacttttttggctgattgaatgttgactaaattgatgtagcaagaatctgtctaaataaatcggtaatataatattaaaaagtatcatcatgggaacttggtacaatgtctatctactaaataaccagtgaagaaagttaagttttatgcttatacactgctgatgggaatgtaaattatatcagccactatgcaaagcagtttggagttttcacaaaaaacttagaacaaagaactaccattacacccagtaatctgatttttgggtatatacccaaaggaatagaaatcatcctaccatagacacatgcatgcatctgttcttcacagcactattcataatagcaaaaacatggaatcaacttagatgtccatcaacaggagactgaataaagaaaatgtggtacatgtatatcttggaatactacgcagctacaaaaaagaatgagatcatgtcctttgcagtgacttggatggagctggaggccattatcctaagtgaattaacacaagaacagaaaaccaaataccacatgttctcacttacaagtgagagctaaacactgaatacacatggacatgaagaagaaaacagtagacactgggacctacttgagtgtagagggcgggaggagggtgaagatagaaaaagtacctactgggtgctatgcttattacttgggtggcaaaattatctgtacaccaaactcccatgatatgcaatttatctgtataacaaacctgcacatgtacccttgaacctaaaacaaaagttaaaaataattaggccttaaagaagcaaccaatgtcaacactatgatgaaaatggtatttgggctgtagtattccattcttcttcaaagcataagcacagtataaatgagattacttagtgggcaagcagtaatagagactcatgtgtgggaatctagaaagactcagcaggctgcagttgtgcctaaatttttccatttagctgatagtgctctaagtttctctatctaagattcactcatttggcccaaatatgcattacctattccaaaactgctcttaaatacaaatatctatggaaataatcacgatgagaaattttcttggcactaaatttaccatgaattaatttattatatctttcatagattgaagataaacaagatactagaaaatgaaaaattttggcaaaggttaaaaacaaaggagaatagaagaattattttaaaataagagataccaactgaatatggcaagtctgagtaaagactcagaggagtgaatactgtggaataatggaagagtataaaagagcttgacacagaaaagaatacataagggagaagaatacggacaaaaaaatttgtgtaagaaaaatttcaactttcattcattgtcactgacttttttaccaggctagtgctggaaatagattaaaaatgcaaagtagctgcattaagattactcatgattttgctttaggaaaaaaattaaactaattgtaaaagttattaataaaaggtttacattagataaatgaaatgataggagccacaaacgttattatgcttatatttcaaagataagtgatttagaattagtttttcatttcaaataattaggtaaccctactttgccttgaaacaattctgttatgaagtttgcaacagaactgtgtagtattcaatgatgagaaactgtcattttgggcctctttagtgaagggttgttacgagtcagagaagcaaagttttataattgaaagtaaacaatcttagtcactaaaatgatattgttattcacctccacagaaagaatcatctcaacagcaagactgcattactcttgttctatgcatgaggaatttagtttatcaattagtttttctttatcctgaatgtgagccaatgtttaattgcttcatatccataattgtattaactatgaataaattgttttaagaaaaaaatctgctccgtggcacaaaggagattaattactaaaagacaatagcaattctttgctatcaatcaaagatgcagaatagcatggctacctaatgaggattcagcttcattaactttcctcaaatctcatttgtaatatgaaacatcaccatatattcaattcccagaaagataaatttaatcaacccagtagtgtgtggatttgtttacaccacccttacccatcatccaactgcaattccaagtccttttcaaactgtaatactttcataccaaattttttttgatagagctttgggccattttcaataaaataatgaaatcctcccaatatccttaaatccatcaccatttcctcttggtattatgaaaaaaagaaattcatagaatcatatattgttagagactggaagggatcttaggagtcattggatctatccctatcattttacagaatgacaaactagattacttaaagaaaatttctctttgagccttgaaaagtcaacaggagccatcaaaaaacatttttcttaaaagggagagaatgccattgaatgacactacaaaattacaaaatatgttccattgtatatgtataggtaaacaattaacttttaataggtatactgttaatgggggcaataataaacactatgctgataaagaagataaaggtcttatgtacaactcaagaacgtctataatctgtaaagattttagcttttctctcatcccaaactcacaatccccttattacataattatttatacaggatttataaagagaaatcaaagagttaagggatcacaaaattagtaatttgccttaatcattattagaaaacacgtgcttactatacatttattgattgtacttttttaaacttaagttacatctttgcatctattcaatataataattctagcatgcttacttattcaaatataatttatttccagtctgggaaataatttttcaaaagcgattagtttaaaagatttttgtagtattagctttctgataaaagctttgagaatttcccagagcaatctgaatttatcgagctgcttttcagcaaaaaggtgtttaattaggttgtctcacacttctctaaacctgaaaacctaatcaccaccttataactcaaagaacacaaaggcaagttgctttgacaattaccccgtgtaaaatctttggtttttccttctactcattcctaacttctatcaggaagaactttgactttacaaatgttttatatatttttaaatcaaaggaaaagttaaagaaaaaaatcaaagtcataacatgaataaataatttccttcctctcttgttagaggcatacgtgtgtatgtgttcatataatcaactgcaagtataaacagacgtttgaaagcagcaaatcaaaaaccatgaataaagtaaatcaaaaaaagagaaaaagtgaattattttattaatgaatatatttcaaagaaataggctgtaacatacaagcttaatgagatacgcttttctctcaatgaggtttcatattcatcttagaaatacaaagaatgattattatcatctattgtgagtgtaagcactctatcatgcaaagaaatctcaccacatactgtggaaaacttcttaaagttgtattttcacaaattcatgcatctaaaaaaatgtttgactcttctctatccctctttaccttactctgtactatcagatacataactttaggcatgaaaatacagttcctgccctcaagaactttcaaatttaatgtaaagaaacagaaaatgaaaaaaaaaacctaaatagaatgactttgtgtccaaaagtcatttcatattcagtaagattccaaacaagaaaacaaggtggatatgacataaaatcacttagtgctgagtgccaagcattgtattaggtaatttcacaataactctattaataggtattactatcaccatactaaatgcttagaaactcattcagaacaggccccaagttatctagttaacaaaaaacaggggaaatatatatatatatatatatatgtctatatgtctgtgtgtgtgtgtatgtgtgtttgtgtttgtgtgtgtgtgtgtgtgtgtgtgtgtgtgtgtgtgtgtgtgtgtgtgtgaatatagagacaggtaaaaagaatcaagggtcaatccttgagaaatatctgtgtataaagtagaaagatcaacagaatcagtgaagaaaacagaaattaagaattcaagatgtgtaagtattaaatgaactctctttgactgagccaactgcctggcagataatcctatgtcttctatgcaatactctctgttgattctatgtagattttcaaatgctattaacctgagcagctgttcctttttttttttttcctgaaacatctaacttttcttctgtaactctaactaaacacacacacacacacacaaacactatacatttgatctccgtactttgagattgctccagaatatattattatcttgcatagtaccatctaccttgacttgtacagaaaatattagatggttaatgatattttagtcataatttctttaaaacaaaaagttattttatgaaggtcgtcttgaaagcatcagttaaactggaactagatcccatttgttctaattcccagtcccctttgtctgatgcttcttctgctaaaatacattggtaagtgatgtgctgttctcaaggggtcgtacaaggatttagccgaagctttatagttagctttggaatgagaattgcactttacccgggcttcaacccctcataattcaagtaaataaggccaaacaggtacgataaataattaaatactattaatgttagacacagtttgaaatttttctgaagatactttgaacaatgcacatttacagattacctacttcttaaaattactaatggcaacatcacaataaaaaattaatagcttctatcatgtgtgtccaaaatagtcccgggcaaactgacaaatatctgggatattttagcagtttttggaattaacaataattgctatcattgtagtttgccaaatcttttgagatgcgtgggtttgtggaaatatatttaagtctaaaaagattaagcgtgaaccaaaatgaaatgtctcattttttaagtagatttaaaaataattaaatgaaacatttattacacttgagcacaccataatctatggaaatgcatactatattgaagtgagtacaaaaaagttaaggcattgcattttatggttagatttttccgaatcacttttacaatgtttcgcaggtttgctgaaatttatcttccccccaacaagcgaaattcagtatttgaagagtaggcattattgaaaacaaatttgtttaacatagtagccagttacatacttgatatgttttgtgtttgtcttgattagctgctttacaacctgaaaattcattttgtggtgctgaataaaatcaaagaacgtatttacttacaaataatggctttcaaaacattccctttatctattatgcatattttatcaactttatgtcatatttttaaaagcatcatatctgtataattgctttcatggtgcactggaatcccactataataattttggcatcaaaattataaggctacattgttgttctggtaacgaatctccttaaaggaagtagtttgtgttgaattaaatttctaaagctaaatgactttattagagtaagatttcaaagtagctgctaaaagctgtgtgtatttctacatgagttggcatgagccagtgacagagtgtgaatcattctcccatcagctgctccgtagggctgggttatcaattatcataagcaacctccagttggtagtcaagctatggctcaagagctccggtgactgtctcaaccccacccttgaagataacaaacctcattttgctttgtgccaaaaatgacaaactcctgcatgttcatgcagggatagcaaaatatgtccttatttcttatgctggaatggcaaaaaacaaaacaaaaaagtttcttctcttaatgatttgtgtgtatgctggagtatgcatatgtaaataccaagcaagagttgaagtagttacatagtggatctcacatccacttttctttatatcttcactttttttaatgaataatagctattaaactaaagtccaagctgaaacattctaagttttaatgagaagagagggcaaacaatactctatcatgttttcatttgacatttatatatattacgatatattttaatgaaaaattaattttgaaaacatcttcagatttggggaaagggcagcagtaacaacaatgtctggcaaaggtcagatcagggagaagagataacagtaaaattatctgtgaggaagaactggaaaacctacgataagaaataactctcaagtgcattctagaatgaagtaagagtctgtgaaaatacttgataatgaaaggtaagcagtattgtactttcacatctatccagcacaagaatggggggcgggggagatagagacagagactgagattccaagtagtcatatgaagataatcgtaataggcacagacagcactttaagttgcactcttttatcttttacagaaaatgtttcatgtgcaattctgtttctctttctagtgacatatacttaaagtatcttttcagatttatattttatctcaactcaatgattccattaccaattaatttttgtttacaaaattatttaacctatactctgttaatgacactgcaattagtaccagggatacagatttaaaagagagtccctagattatagaacagtctcataagggaaatagatgagaccatcactatctgggttgatgcgtgatgggatggaagtgagtggtgtgccgtagaacacataaggtaacacttcatgtaaaatggggtgggatatggtattagggaaggttccattgaaaaggtgattccaaataaagattcaggaatcacctttggtgatgaaggaaggaggtccaaagtatattgatacagcacagattggagattggagggatagtggtgaaagatgagggtagttaaataggaaacaaatattctgtttaaagatcgtgcttactattagaactggatttttgtttttaggtctgtagaatattgtagggacaaataaattgcctttcttctttgccaggtgaaatctcctgtctctaacccaacatgttatctctcccagagtctataatttcctaatcaatttcatgtatttaaaaaaaaaaaaaccctctggcctaacaaaatctctaccaaattgaaacctttcaaccctttcacagcttggcctggctcaccctgagaagttcacagaataatctgcaccacagagtcatagctctgtgactaccatcccacacttttgcaactcttaatgactggatcagaggagggaggatagataatggcagaaagggtcttaactcagctgcagagagttacactttgcagtgggtgggtgtagagaaattctagtgctgactgtctcctggaaagcttttgcagttctgcagaaattcccactttggggttatctaaatgtagtcactgagcaattgtgattccttccccagctactcagtgagcctgtccataaaatctggattctactaatttacaaccacctcttttggttggagacatcttgatccccctacccacagccaaccaactatcctctttgctttttattacatagcttcaaagtagaagattagctaaggttagaactagattttggaaccattttgcaagtccatatacatggtctaataactctctttaaagtaaggatgtttggcattcataaccactagctttggggcctagccaaaatttccagacaggaagagtgccatgttaacaaccagtttactacactatgaggtttggattttgtcataaagacaatgctagaagaattctatgggggatgcttgaaaaggcagactagctggacacacctgaggtggggattcctgttggatagctactgcattgctacagtagggagaaaacgacaggatcacagatctaactagtgccattaggaatggtgctgtggaaaaagattcaagaaatactaaggaaggagaattgagatgatttaggcttggagcttgttgttttagttggtctgtttgtagatttgtttgccttagaggaagcacaagagaaaacagggacagttgatggaggggagcaaagtcattagagagtaaggaaaaagactgaaataacaagagaagattgttagacttgaacaaaatagactccgatttatatttgtcagaaataagagagatagataaagacgattcaggatgagaatagtctgggcaaagaaactgaggtagttctcatctggtacattttttttttttatatatgtgaatagaggatggttgccttaaaatgaaagaggatatggtagagtgggagaaaagtaatacaaatttgaaataatacacttctttggggaattgagcaagggaattatctaagaataaatagattttacactcttcaattttctgaggaaaagtatccttttctcatgtaatttttttaaagtcaaagtactgaataataagaatcagtgaaaaattgtggctagtttaagcatgttgctatcaaataaatgccttaattgttttgacacagagaagaaaatgtgtctccaaggttacatcgttggatatgaaaatttatagaaaaattaatctttactaaagattacttaattaggaacattgttattgtgacagaatatattatataagagtattcagaaacaaaacctaaggtttaaggaaaatttatgagatgaataggaacaggaaattttacatttcaccctatcagcggttctctgaataatacatctgatgttttaagcactccagaatacatttccaaaataaactgatttttctaattcaagattattagaaatgtttaaaatcatgtatgtgctacaactttgtaactataaatcataacataaatgtaaggcattataccacaaaaactagaattgacaggcatataattttctagtatatggggctgagaaatgaattacaaatggtctttttgttgtatggtagaaatcacttttaatgcagtgtgatgtgtcacaagcactaaagaaataacaaggctttgataatcctggtcattctccataaattctgttgttacgtggcatgtgcctcagggacgacacagacaagttaccagttttcagaagaattaaacattcagctacaattacttttaacataatatgcatgaaaataacatttccaagaagaaaattaagcatatattttctccttctaatgtcttttttaaactatacaaacacacacacacacactaccatgtgttttaattatatcttatcttgctatcccatcagttatatttatgggaaatgtgcatatatatgacattatgcacacacacacacatatgtctacctggaataaaggcaaaatatatgcaacacattttccacattgaaaaatacttgtattaaatgtcaggatctttcctgaattccaggtacagagagaggaatcccagtccctgacttgaatgagctcatggtcccaggagaatgccattcatttctatacccccagtataaaacaaaaacaacaataaatagatgttatttgctgtaaaccaggcactgtgctcagcactctacagacataatatttgatcagcacaacaatcctatcagtaggtgctattaaggcccatattttacaaatgaggaaacttagttaaaaacctagagaagcagtaggatgggaggaataagttactggagcacaaagtactatgctcctattttggcttggctagaattaatctgtgctgagtctgggcaaattctttcccctctctctgagtctcattatttaccacctgcaaaatggactcatggagccttgtgagctacagggctcgaaggcagtgatttctttgctgcatgttagaaagactaagagagtttccaaatattaacatcgtgataccatgctgggatcccacatcacttaattcagaatgtctgagggtagaagtcaggcaccagtttttacgcagcacttttaatggacctaggttgctatctaacttggtttaagaataggaaaacaagtgggccccttctattttacattcaaacacaaagagatatctggaacttttttttttttttttaagtggatacccttgctttctggaattcccatcaaagaaagcaaagggcttatggataggaaacctaataaaaccttaatcctctactctattaatactatgctgctccagttaaagcgagagtttgtgaccttcctttttattaaaaactaatgtgacacagtttttgcaggtttgaattacccataagtatatacaccccatcgttaagacattttggctttgtgaagagtttcacttaatgctccatattggggttataattgtgtattctcattttctcacatttacaaggaagaatttggatttcccctgcctctgtctttatggaatagccaagatgctgacacctttcctcccagacacttatgattctagtttatagctgtaataatcacaggcattgtgtctcttgtaatatccacttgttcaaagagtaaagttttatttacatacttttattttcacatatttactttgctttcactggcctgtatttacctattaatttatttgcattactgagttaattacatattgacgattctatgtgtgttcagtttgtgagcataatcttaatatttgttgtgttacaaaggctcacaataagagcagaaaaagatatattttagaaatattaatgaaaagaaaatgccttagtggattttattacaacgaatgttaactattatagtaattcaatttgtttcatcataaatgaacacagatttgggggctccaaaacacgtaaaaaatgttttgcagtaattcatcttaaaagcttttattctttaataaactatgctggctttgtgggagaactttatatgagttatttcagtatacagaaacaaagattctaattgcttctgaacacttcatctttaaccctatttacattagcagagagaaattagaaattgattaacttttttcagccaaaaaatatcttcaaattgagttttcttctttggcagtttcttatgaagttatacatattctcacttataatctagcaattctactcatagatatataacctcctcattccagcaaagtaaaagcatatgtccataaaaagagacatacaggagaagtttcactgctatttataataccaaaaaaatgagaaacatgaaggtacatcattacgagaatggataaacaaattgtagtatattcatattatggactactactcatcaataaaaaagaagaaattcttgccacacacaaaacacacaaatgaatctcaaaagtatgatgcattgtgaaagaagacagatacaaaaggaatacatactgcatggttccattttatgaagtacaagaataggaaaaacacacctataggacagaaattggaatagcattttcctgggttggagataaactataatttttcccttgatacacaaaaatctctaaatatgtgtgcaaacacacatatacgtatgtataacaaagcctgcagcaaaatatggtatagaaattattgatatctgtttaatactcttagcgactcaagtagaatatattgtttagcaaaaaagcaaggttatccaacagaatttttagtgtaaataaatatatcacatatataaatatataacattcacatacatatttataaaatgtatactcatgcatcataatattaattgaaatatacctgtgaataaaataatgagatctttttattttgggttttaaagcattctctattgtcttttcagtaatacgcatatatttttacttaaaaaggatatttctatcttaaaaaagaataaatatagcaattgaatttagccttattaattactttcttctctctaatgaagaaggaacatgaattctgcaaattagttgtatgtttttgaatttataccatggtactctttttttgtgttttctgttcatttatttcttgaaattttttataatcctttactttgatccttcaatattttactctttttgtcaagttgctattttgtgaacacaccctatttacaagctcttccatgattctggacagaactcaggcctaaaaaagattctaaacaccaaatatgcaaaaagcacattccaggagaaatgatatgtgtgaaaccatagagtgatttagaaatgtgaagctgtttaacatatctaactgaagccaattacacaagaaaggcaatgagatatgcagcttttgagacaagcaatcttatgactggagaacgataaggcatgcgtgtgcatatatgttatgcatgggtaacagaactgtgcactttataaagggttcctaataaaacagagttttaaaataatctcaaagtgtatatgtttattgattattcaagtatatctactgttaggtgactctattcatttctagtacctcttgttcatttgctcaacaaataatagatgtgataccactagataccaggtagggtattggaagaggtgtttgtgacagcagtagctcgacagatcttatttgcactaaggaaaagacatagcaagcaagcctgtgtgctaagcacaaccaaggagaagttgagggtgttagaaaaggaaggttaatgatttaaggaaagagaagtgctcactagtgacactgaaatctcagaatttcagtaaggatgtatcacatataatctgcttttggttctcatgcatctagtcacatttttttaatcactttagaatgtgtacctagtatcacttacaaaaatacttcaaacaatacattaggtgtctggataatttggccagcatcatgggctcacaaagaccacttagcaaatacactggattatcaaaaacgacactaagtgttggacaatgttggtgactgcacaatgttgattattcaggtcccctttacatgcccaggtgcactcttcccccaggtgcagtgttagctgcaaacagtttacagctgccccttctctaaagaatgaccctcagctgaacagaggctcctcagaggttttgctacccttcgctagtccccacctcttctccctggggcctacagccaatgatggattctagcaggaatacaaaaggctaacccctaaccatcactgatgtgagactgattttgtagtgcagttcatgctaaccattcctcatgggatcaggctgaaaggagtgttctggctgaaagcttgttcttgcttagctctttctctggcttcccacattcccttacctgttcttcctgagtaccctctgaacaaacaagaaattcaatttcaggctctgcttctaggaggcctggactaagacaatgatactgtcctgtaaggaaaacggatgggccacggtcaagaacaggctgaggcagacatctgatccagcaagacacagcaagtttggagtgcgggcacacaattccactcattatataaccaagccaggtgaggtgcattaggtgatcacccatgtgagttcgtacttggcttggagccactattgtatgtacaaggtataactaccctgctgacgctgtacatacggcttgcacccaggcgcgtacccatgacttgctggcgcccagagaaagagtaaagccatgtcgaaattccctacgattcctcaagtgttctttcagctgcccaccactcgttcacccactcccctcggtcctcagcttgggctggaacctgacacttggtatagccagcaggatactgaggagagtgagcctttggtccccactgattctgagtcagccatgcagctgaaacattggttgtggtggccggtggcagcttactgctcggatgggatccagtggaaacctgggcggcagtagatgggtcccccgtgaggatggagaaggcgctgaaacagctgaagtacagagcaccaagaaggaataagcctttgctggcagagttggatgtgcatttttgaccgcggtacaagaagtacacactcagcccctgagggatgcagcggaggtaagggcactccaggtgctggtgggcacctggaggcctggctacagaacttggaaaaggtattagaggttgctgtgaatgcaggcctgggtccgttgtctcagtcggagaccccattaggtctgatacagaggaggctgttggcagaaccaaggggtccgcgctgtaaagacggggaaaatgcgccacctcagaggtcctcccagaggagaaaagggaccctaatgagtgacacgctgacagatgtggatagatttgattttggccaggttgacagagagaaaataaataagcagcccaatgaagtactcttaactttgtggagacagttgtccccagagcagcacttccagaaaatgcccaagcgggagaaggacattgctgtgcaacccggtcccccctaggtgcttcaactcaaagactacgtgctgcagccatgcagggagtataaagcctttgctgtttgatgagggacctggctgaagtgcccggcttgcagggatacctgacaaccagaggccacgtgtggagctgacaatcgacttgtaccccaccaacatacagagagtgctggtgctggtagacaccagcacggatacattctggaagtaaatattttacacagcttggtagctgtgccatctatcgtggacttgatggaccgcttgacagtactgggacagtaccactgtgtagtggacttggccaatgccttctcttcccgagagccaggaatagcttgccttcacgggagggcgacaatgaactttcacagtgttgctgcagggctatagcatagccccaccatatgtcatggtcttgttaatgatactatgctaacctctgattgtcttgcagatttagaagtggcaaagctccccttgcctagaattatgatggtgcggctgagaccaccttccaggcagccaaacgggctattcagcaggcacaagccctacgggtagttgatccagggcacctatttgagctgcacgtgcatgtgaccacagatggttttggctggagtctatagcagcgcatggagtgcttgagaacaccagtaggcttttggtctcagctatggaaaggagctgagctccattattcattgacagagaagcagttagtaactgcatatgctgcccttcaggctcatgacagcatggccggatgggctacagtcatcgtgcagacaacttacctaatagcagatggatgcattcatggaaaatgaccccccaaactgggacgcacagacatccactttagcaaagtggggcacctacttggagcagccaagtatgctgagtacaagtcccgtagcagcagagttgcaagagatcttgggacctgtagtcctaatgcaagataaggccatggggcctgaggcacccctagacctcaagccttcaccgtttaaggaagggcatcctccattccctatggggcatagtacacagatgggtttagccaaggtgctactgctgcctggactgctgttgcactccaacctagtattgacaccatatggtttgataccaggtgtggacaaagtagtcaatgggctgaacctagagcaatgtgaatggtgatcaccaaggaggtgacaactatgataacctgcaccgacagctggggagcttatcgagtcttagccttgtggttaactacctagaagttacaaaagtaactagttggtcacaggcccatatgcggccaggccatgtggcaagacctaggggaggaaggatgaccttctccaaccaggtatgcggatgaacggtaacctgttgctgcctgccccaacacccttaaaggtagggaaataaaaacctggcttaatgtatgaagcaacattagggtaaagtcaccatggggtggttgcctgccataacctggagttgttgttccctgtattactgctgtgaactctgggtccaggattccaccctgtgggcacatctcctcactagaaaaactccctcagcctagggagtggaatgtaaggcctatgtgttaaacctgtgtttctgggacctatgtgcccagagcctatgcataaggcttatgtgttggacctgtgtgtccagggcctgtgtgcccagagcctatgtataaggcctctgtgtcagacctgtgtgtccaaggcctatgtctgccttggcctagggggtggagtgtaaggaaaatggatatgctgtggtcaagaataggccaaggcagacatccagtccagcatgactcagcgagtttggagcactggtgcacaactccactcattatgtaaccatgccacgtgaggtgcattaggtgatcacccaagtgagctcatgcttggatcggagtcactgttgtctgtcaaaggcataactaccctgctgacactgtacatgcagcttatgcccaggtcggcttgcacccaagttcatgcccaggctcacttgcatccagagaaagagtaaagccatgtcaaaactccctatgattccctgagtgttctttcagctacctgccacttgtccacccactccccttggtccttagcttgggctggaatctgatatttggtgtgacatgccccaaaatttatataatgatttaaagaatatagatttatatatgtaacacataattattaaaatcatatatttgcaatgtgtttctttatatattcatatgaaatgaatattttgaaggcttggggggaatcttttgctcattaagtctgctcctattagagtagtaatgggggcagtacctactgaatcttactcccttccagctaagtattattcccaactgataactctttccctgtcttttaagtttcaacaagtaggacaacatatgttgtctttctattgttgacagaggacacagataaaataaagaaattacctttttaaaaaaaaattagaatacacacacacacatatttgctatattttcccgtcaaaaatggttacaatccaaatagtctaagttattagaatatcctagaagaatgcagatactgtagccccaattatttctacagtataagtcattttgaagagtagattttgctatttacgttttccaagattacacaaatataaattcaactcatgtaatgcataattgctgaccatttgaagtattaaaaaggtaaccacagagcagtgatacactctgaaataattcccattaaaaagactgaaccaagttaaactgatttgctccaattatttttattacatacaccttttctaatccttttcattttgatagatatataacttaaaaatttttttgttaaaaatgttttgttaactagttaattaaaagttaaagaaaaaaacacaagaatgtgcttttatctggaggtttcccattaatctctaaaggacaatttgtttctgaagtatatgattcttctattaatcatgactttaaaatatgtacttaacaaaatatgacttgaatgtaaatgttttgagtttcttttttcaatttcttgaattaaatcctgaactattatttctgaaatcaaatttacaagctcagtgtgaatcaattaactgcacttagatcatacttcttagttgttggtagataaatatatatatatatttgtcgttgttgtttaaaggctatatttttgcacagaatgactgtttaaaaatttaccagtttttaaaattatctttcatgaatgagaaaggtaaaagagctaagtatataataaccatgaaatcaaacatttattatacactaattgtaataactcttaacaagtaacaaccatgcatattttacttcctacttcatcaaatggtagcaatactaccactgctaaaacattcagtaaaccaaattagatacttaggaaacaaaataattagctgcactcagataaaatattaaaaatatgccataaaagatgcaaatttaattgcaagaacagtttctattccatttcttccagcaatgcctgaggcttattatcttttttctaggtctcaaaatggcaggaggtaaccaatgcttttggtagtaaaatataatagcaggatcccaaatttaaaataggataaaaactatttttccaatagtggcattactaacttggaagaataacaactaacaggatatacagtgagagatatagatatgtttatatgtgtatgtgttacaactaaaaaacaaaacaataatgaaacttatgtattattttaaccatcctatatataatattctttagagaataaacatctttttttaaccatataacattagactcatttataaagacaaacaaaaacaaggaatacatttattgaatggaatttaaacatagttataaaattgcaaaaactccctttcctggtaggccaggtgattgtaaatgttcgcaacaggagcattacaagatttttaggcagaacaagtcctcttctatgggagtatccctggccccacccactaaatgccaccaggtttcactgtgacaatcaaaacaccctcacatattttcaaaaacttggggtggggagctggtaggtgtcagagggtattatatcagcccctggctgagcacatgatcgctcccaggtctcagaatggagcaggctgaattcagtaaacatggtcctaccatagtagctctgtgctcttagaaaaattccctctctatgcctcagttcatgcttctgtaatatgtctttttcttagcaattgtttgcaaacctcccagaatcattgtatgggacaaatgagacattcacaataaaacagctttgtaaagtatcaaatgccatccaaaaattataacattttgtttcatttaacaattatcctatgctgtacttttcatgtttgattagagaagatttgaggttaaaaaaaaaaaagtatgcattactgtttaatttggacacaagtatactaatttggaggctgcagttttttcagttatcaggacagaggcaattttaatctttgaccctgtgctacggccttaatgaggccacatagtcacctgctggtagctccagaggtgaagaaaaagaagctggtacttagtaggaatttaataacctctttaggttttgttccaaaaaattcagtcttgtttaagtggaagcaacaacaatatgcccattttaatttaattctatagatttaggaaattacagattttcccattccatagatttgttttcaatatttctaaacacatatatattgaaaaacatgcacagtatattgctatagagggtatacaaaaccctcccatttcttcattactgaagttgaaagatcattgcttgctctcctaagaggcttataaagctgtctaacttttaatggcaaatagcaacatatcacattctgacttgctgtgaacttgtgccatataccttaagggtgagaaaaggtggctgtcactttatacaaagaatggtgcttctataatatagtgacagaattcacagtgcaatgcatgatattgcaagaattactgaaaatgactcaaatttagatttgatccttaaaattgttttttaccttttaaatgtttaataaatatgcattatataagtgtatgtataaatatatgtatgtaaataatatacattaacgatagtacttaggttctattttctacaggaactcttatttcatagcattaacgacttgatatcattaatagtttgtcagaaagctatagaatttacattaaaaaatattcaggctgattgttcaatttaccaaatatgtttgttgctatttctgcatcacagaggctatattcaaatagcctgaaatcaaatataaaattataattagattaacaactacacaggtaacttcccaatgtgtttttaaacaaaaataaatcacttaagatgagtgacattattcatattctaaatctactattcatataattccccttaaatttgcttctgtaactcttgttaaaaagtactgaaaatggttttagaaatatctttactttatcagatttataagcattcattatcattatcaaattttatcagtttatatttatccaagaaaagccccagtacacaacgttttagtatggaggaataagttcaagagttgcattgtacaacatggtgactatagttaacaatgtactgtatttttgaaaactgctaagagagtacattttgtgttctcaccataaatgaatgatatgtgaggtaatacatatcttaactagcttgatttagccattctacaatgtttacatatttctaaataataggtacataacagatatatacaatttttatttgtcaattgaagttaattgattttaaaaagaaaagctcagcttatatataaaaatgatttccagtgattgccttacaaatataatttcccatattttacatcaatgaagcaattccagattcatacacattccaattcacacacatctacactcacagcgtctcatgcaaacatacacacagagagctttttaaaataaaacctgcagagtacatttcaaccaaatatgtctgggggaaattaaactgggaaatggagaccattcatggagtctcagtgcagtagcaaactcttcacttctacttattcattctgtgaaagccgtcatacatctatgtccactgatccacttgcatttggcataggggttggtagattatttattgaagggatttatgtcagactgggattaagatgtcctaagaattcccaagtgtgcaattcatcacaacacaatttagagagtgaaaagagagccacaatagaccttggtagcaaagtggaagtgagtgataggtgaaccgaagcccccagcttgatctaaagaaagcagacaacatataccaacggtgtcaatcaaaccgcctcataagcagccccatgaatataaaatagggaacaaacagattggtttttctttccttgttcccaacagttataagaagatagattccaacactaatgagcttgtttttgtatatatgccagggaagttctatctctaattttttcttataaccaaagaaacaaaaacacgcatttttctgaaataatggaggttgtgaaatattttatttttgccaaattgttcccctacatagccggtgccacatttttgcgctgtgtgaatcaaataaatcttgcctctttgtttctaaaaattaacaaactgaagtatatttttggtactttcagacccacatttataacacaacctaaaaccatccccaatctaagtgtgaaacttaaatcatcatgttaaacttagatttaaaaaattaaaaagaactgctaacaataaagcaaatgtcactatgtaccagaattctttgtggaggtcagtagtcaagttagtcaaattttctcaacttaaatataaaagctatatttttcacagaggctattattgataaaattatggtccccaacattagtgcctggcaaatggcttgcactatagaagtatttgttgaataaatgaattgagggtaattaataataagttcattgttttatttattaagattagttcaaaacagttctccttaaaattatgctgaatttgtaatagtttgaaactaattctaatcttatttgaagtatgcctcatttactctatttattggtctgatatgttatgaatgtattggaaaatgtcactttcgaaggaataaacatctctggaaaaacggtaacaatattgactcttcaggtctcttggattggatttcagctaggaggtgggagttcagactgtctcccatgccagagaactataaccagtaattgttaaccttgatctgtgacttcagcagtaaggggtcatatgagctgggacttagagataaagttttagattattggatgggtgtgtgcaggctcttcagaggttactggaaattgcactgtgtctgggtaaaagggagacaaccagactccttcatttggaacatggatttttgcagaagtgtctgttagttcagcataagtatcaagggatttcaaaacattcatgccttctgagctagtaatttctctctgttcctaggaacaactccagttaggtaaggggaaacgtctaatgcacaaacatgttcaacaaagaattacctcaccattctcctgttgtttcccttttttctattaaatttgaaaacaagaaacttatgaaataatatagaaatgctcaactcatgtttgtttaatgaatgggttaactgcttaatatgttaggactagaacagtaataatatatgcagtagaaaaaaatacctgaggttttttatgtgctaggcactgtgttaagagctttaaaaggattttcccatatgatgtaatcttcacagacgtgctataagtagacctatttatataaaacattattgtttatatgttttcattttctatctgcacagtatctcttctttgataatagcacctcaatttttatggtgaggctccttctagaacactctcaatcaatttcccttgggacagggggattctttttaataaaagttctttttttctttttcaaatattattttaggtccaggggcacatgtgcaggtttgttacatgggtaaattacatgttgcgggggtttggtgtacaaatgattttgtctaccaggtagtgagcacactacccaattggtagctttttgaccctcacccttcccccaccctccacccttaagtaagcccctatgtctattatccccgctttgtgtccatgtgtacacaatgttcagctcccacttataaatgagaacatgcagcatttggttttctgttcctacattaattcacttaggataatggctgccagctgcatctgtgttgctgccaaggacatgatgttgttcttttttatggctgtgaagtatttcatggtgtagatttaccacattttctctttctaatctactgttgatgggcacctaggttgattccatgtctttgcaattgtgaatagcaccacaataaacatacaagtgcatgtgttttttggccagaatgatttattttcctttggttgtatacccagtaatgagactgcttggtcaaatggtagttttgttttaatttccttgagaaatctccaaactactttccacaatggctgaactaatttacattcccactggcagtacataaacgttccctttctctgcaacctcaccaaacacctgtttttgttttgttttgttttgttttgttttgtttaatttttaatagcatccattctgactggtatgagagggtacctcatcgtggttttgtttgcatttctgattattagtgatgttgagcattgttatatgcttgttgaccacgtgtatatcttcttttgggaagtgtctgttcatgccctttgcccattttttaataggcttatttgctttttgctttctaagtcccttatagattctgaatattagaccagggcaggagaatttagccagaaggcatataaccaggactaatcaacactctatcatcttgatccaaatgatggatataagaataatcaaggggcccaataaaggttgccagatctagcaattaaaaatatgggatacctaattcaatttgaatttcagacataaaatgaatcattttttaggttaagtgtattccatgcaatgtttaggtcacactttgtttacaaaatgattcattgtttatctgaaattcaaatataattgatgcattgaattttatctagcaatcctacaaggggcaatgttaagactcaatccaagacttatactcaatcattgacaagaagtatttcattttttccttgcagtagataaatttgtagaacataagcctatagttactatgtgctatcttttattcaacatggggaaattcagcctgggaataaaactttcacagagaatagcagagtcaaggttcatgtgagcagatatggatgcattttatgtcatttgagcagatatggatgcagtcatggctgaagccatttgccctttagactttgtctgaactggcacaattcagtttatgttacaatacattttttattgaaacataacttttatttatgtcacatgggactgaaatatgctggtataatatgccattattatcctcataaatgatgaaacaagtattgccttgatagatttaaggtttcagagcaagtatgtggtggatttgggaagacaagaagtctaggtacaatatcctagttctttttttttttttctgagatggagtctcactctgtcacccaggctggagtgcaatggtgcgatctcagctcactgcaatctctgcctcccaggttcacacaattctcctgtgtcagcctcctgggtagctgggattactggtgcccacaccacgccctgctaattttttgtatttttagtagagacggggtttcaccatgttgaccaggctggtctccaattcctgatctcaggtgatccacccaccttggcctcccaaaatgctgggattacaggcatgagccactgcacctggcccaatatcctggttcttaagtaatattctagagtgtttttcaaaaagacaactatataatatgataaactgcaagtaagtctttaaaaaatatttacacacacacaaacaaaaagagagacaacctcttgaggagctagtcttgttgaggctggcagagtacaggatcccttgggtatattcttaaggctgatatatctaaggtcagacaaggtcataacacttccaagtaaaacagaagaaactcagctctccttcctcacctgtttgtacttctataaggctgtactttttcttgctacaaaacacccactagatttgaaatgcaagctcactaaaagccaaaaactaaaacaaaacctgctttcaattaaataatagaataatgcacacctaaaatacaaatttgattatgccactctcctgcttacaggcaaagtacactttctctatgttgaatgtaagaattttaattttctgaccattgtttactcttctgtcctcatcttttgtcaatctctgctggcacctggctgacttgtcacgctgaaattctggcagctgtgtacagactcaggcttttttttagcctcaaaatatcctacactgttctgtgtacctggaattccctgcttaccccttttccacctgtcttcatctactcaggctactataacaaaataccacaaactgggtagcttttaagcaacagaaatgtatttctcacagttctggaggctgggaagtccaagatcaatgcaccaggagattcagtgtctggagagggcatgctttctggttcatagatggtgacttcctgctgtgtccccacatggttgaagggactagccagctttctggggtttcttttataagattactaatcccagtagccaggactctaccctcatgacctaatctactcccaaaggccccactctttaataccatcaccttggggattaggatttcaacatgtgaatttttcaggggtgtaagaattcagtccattgcaacactggaaaaattcctactcacatttgaaaagtaaacttacctacctcttccgagaaagcctttcttaatctattacaacccttcctcagttggtgagatagtgctcttctatgtatgatacaattcaatagttaagatgcctatttcatgctgtattgtaccctctcattaaccagtcatttggtgcaagtttccttcggggaaggagcaagcccatgcgcaaggtggctttttttttttttctttttggcttgagaccatcaactgttaaaaatcccagcagctgggaaagtaaggacctcaatcctcaaagaaggttctgagtgagcaacatagcacacaatatccaacttggaagttatggaagtctggaataaaactatatcatcagaaatcagaaaaaatactctataacttaaaataatgggcatagttaacacatccatttaaaataaaaagcattgtaaatgactgcagccaatccatacatacaatggattctgtttacaatgtatcaaaattattacttgtagcaagttaaatatcaagaaaatcaattaactcttcatttcctgataagtcttgtgaccaaaaataatttacaaacctccaaaaagttaaactattatgaagtaatctaaataatataattcatcatttcagctttatcaacagtctcttccttttggtgagacattaacaaaaagaaatatcatttaagtcagcatctcaaagaacaattaattcaaataaagtttaatgaaagcatttagccatatgttgaaaccaacccaatagtcccatagagagtttttggctaaacagagaaattgaccctcctggtcttaaagcttgaaatttacatttgtcttacatgagtttcttcctcaggaaaggaacttcaggcctctccaaaaaaatgatgaaagaaatgaaactcaccagataccacacccagacaagacagaccgctcattcatcataatttcttccttggccctccattattcctgttttcttacatattggttcatttcttccctgctatacaaaaccctagtcttattagtcagggagataggtttgaagctgaactcccatccccttggctgcagcatcagattaaagccttcttccttggcaatacttgttgtctcagtcattggctttctgtgcagtaaacagcagaacgcagaccaaaccgcagggtgtttcagtaacagtatcagaaacataatagcaagcaagaaatcttgtaatttcactccaaataaaccattccatgaaaataaatatgatttcttagaaacttgaaatatgatttagcaataaatattacctaatatataatataattaagctctaatgtaggtcatgtatgagttcttttataactattttttaaatttttcctgttacactttatttatcatgttctaatatattaagcatttaaaataattttaattaatacttctttaaaattcaatgccatagtcttttaattgtttcatatttcttattgaccgtgatttcttcttttatgccaaaatctccttgacaggaattattttcttaaatcactaaaattcagaatttgctttacccaaaagaatgtttttcaaattagttctaccagtatttttgcatcttgtttttatactgagatgcatttattctgatatgccatagaaaactctatgcaagaaaaatatttcccagaatccaattcaatttgacatgaaaaaaagacacaaaataaatcttaattgtgcctcagaaaataatcttaactagtcaaaaatcattttgcctctaactgagatctttctgctcagtttactctgtcactttatcacagatttcttggccatattgtctaattacaaaaccatggctcttgtttctttatacagagacttgtaaatagtcaactcaatggaaaaaaatgcatcttataagcctgtggtagaaataatttttcacaagtggtatgtcagttcagcatcaatttgagaagttcccaagcctaaaacaatccaatggagagctcataagaaactagaaattagagcccaccaaaacaaagattagcaaactattttcttgtatagaacaaaggcatgactttgcaaagcactgttgcattaaaattctgttctggaaattgtttttattcacctgacattcactcctctttctgttttcaaatattcattatactgtttaactttctcaccacacaaagcaaatctttctggacagagtaatgacaatagaatatgaagcagtttatcaaaatcaatttggtttgctacatattcatgagatattttattataactactccaaactttccttttttcaaaaatcaaactgctgatttattcttttttctgaagcattctgaagcttaaagcatcaccataatgagatagtttgctcctaagaagggttccattttgtcaagcatttcagctatccaaagaccaagacgcctagcaaaatcaagtagctaaagcacaatgaatccaagaggaaagaccaaaaggacagaacgtcctagatagcaaagaaacatccataaatttttttttaaaaaaagtaaatatatctgtcaaaaaaatagctatacattctaaacttgatcttcaaattgctgttaagcctaaatccaaaaaaaaaaaaaaaaagaaagctggttaatcctccaataattatattttctacagatacagtgttgaagatgtttttaattacattatatgtcattctttttatgtcaaaccagtggagaattaatgtatagttgccaaatttataaggtgctgtttcctttattttcataatgtctttgaccaactccattaacgacagaagctcaggatctttttattagtatcatctttctgactgaccaagcttgtgagtaaatttttaatttgtttctctcaagcacctttttcctggacccttaaaacaatatactttgaattaattgcaagtcatacacacaaggtgacagtatcctgaagctgtaagatttaaaagaggacaatcaactaataaagataaacagaaaataagatgttttacttcgtgttacattgatgtctgttgcatcctgcctttttaaaaaaaaaatatatatatacacacatatacacacacacacatacatatatatatatatatatatatatatatatatcaggaaaacgactatgtctttaggatataaagaaatttcacggctatgtccaaataaattcaatccatttccaaagtcaactaaaaagtttttttttaatgaaagagaaatagaaaatgtcaagtagaactataatttcagcagttatacagcagtcattatactgttgccaaaaactgaagatctatcaacattcatggcacagtttcacacacacacacacacacacacacacacaatctttatcatcataattggtataggtctaacttaatttaaaataaaaacaaaaataaatttaaggttattaaaattcagaatagtttcaggggtaaaatataccactaatactccattttgaaaactacttttcagctagtttttcatcattctgtcaccatcatcatcagtgacctacctacatgtactgaaattttttttttttaatgtgggaggcactatgtagggcttcaccaagactacattatttatttatttatttatttatttatatttttatttttttgagagggagtctcgccctgtcgctcaggctggagtgcagtggtgcgatctctgctcactgcaagctccgcctcccgggttcatgccattctcctgcctcagcctcctgagtagctgggactacaggcacccaccaccacgcccggctaatcttttgtatttttagtagagacgtggtttcaccgtgttggacaggatggtctcgatctcctgacctcgtgatccacccgcctcagcctcccaaagtgctgggattacaggtgtaagccaccgtgtccggccgactacattatttattatttaactctcaggaaaacgctttcaggcagacactatttttattctcacttaagatgtaggaaaacaggtacataaggaggctcgctctcttattcaagttcagacaactggtaagcagtgagcctagaatcaatgaagacagtttccctccagaccaagaagcagtaagcctgaaaacacagcttctcttaggaaacagcaaagtgatttgcagactttattccagattgttttctatttgataatatgtcctggtaaaaataatgacaccttactataaaataggagtgtagaacttgtctacaccacatatttgtagatttttttaaagttataaattgattaattaccaggaaggaagtacagaaccaagatgagtgatctaacttctaatattgactaaaaatttcttttctctgtagcagctgaggaatagccacaacataagttgtgtgttgtgatactatactaaaactcaagaaatagaagtttcttaaagcttgtaaagtttagtgcaatgtggaatcttaaactctatcaataaactttattcctttattacattaaaacacactgatctatctactcatgcattaattaaaatatcaaatagttatgtattttcattaatttttaaatatttctatattatcaaaataaaaatattagcctatatttaagagaaatgagcatatgtggctaagttttgcctaaatggtcttcatgggatcctccatttaaaaggcagcttcttttctatattctgtgatgcaagtattaattgtgaattataaaaatttatcaaaaagatgttattaaaattaattcacttgtacagtggtatagcctaaggaatttacaatggtctgaggtagctacctaataaacacttgtctaaaatgcattaaaagtctttgggattgcaatgccttgagacctatacaatctgaattcatgcagaaaaaagtggcacaggtcaaatctctgctacttagtaggaaataatttgatagtttgtattattgacaatcacacaacaatatagcatactgcataaaattattttacatattttctaaacttggaaataagcataattggttctacataattttttttcaatttctgtatcacttaaatgaagacatcatgatccattccacatctacatttctgtttccaatattaacaaaaaatcattaacttaagaatttttgctgtttatgtgtgacatttaatatataagaattaaaaggctatccattatctattgtatttatttataaacaaagaattgtagtctaattctaggtgacattaagttgtgttttaaccattttagaaagattttcaaaggaatgtcattttctttgaagagcaaagacctagtctcagctttctgaaaagtttaataaactagaaaactgtcataatagttaaaataactttaaatttatacatgcttaaacaaaaattacaagcttgactcaaatttcaattacatttaattatgaaatatctaagcacatttctcatctatgccttatgatttagttttatcttattctgatgagaacaacatttaaatatcagtagttacaggtacctaccaaagaacagcatattcatgaaaaatatttgagagttagaaaaacacctacaggttttcaacggattttatacttagaatctttataaaattattatttcccttttgcatgatacaaagattattgtagattcactgtttttttccattaaaaatagaaagtatagcttttgacaacagcagaagtcacaggcattaataaaaaactgcataaaattagaaatagtgatacttggtttccacttcaaaacagagggcacgcagcaaatctttaaacatgtcaatatctgttaacatctacgaaaatgttcaggcattgttgtcaatcaatacaaaaaataatctgaaaataagatacttttgagaacttaattatgtaggtctgatggaaatcaatagattgacggtaattattttttttaaatccacaagatgcaggagttatattcaaatatcaatgtaaatctactttaagaaattcgctgcttgggtttaggtggatctttactgtgtttggttgaagtcaaagcacatctttatgttatagatgacaattttgttccaccagcatttctcaaatgttttggtctcatgactcttttacattctcaaaaattactgaggacccaaaaagcttttgtgtatgtgacttatagctagtattatttactgtattagaaattaaactgagaaattttgaatttactatttataaatcatttaataaaaataaccccctcatatgagtaataatatattttaaggaaaaataactggagttttaaaataagatgagtggcagagagctatagtttgaaaacaaataaatattttaatagccattgcagatagtgctggaaaatcttttgtgatgctacaataaaactcgagaaacagaaaagtttctttctttcttttttctttttttttttttttgagatggaatctcactctgtcaccgatgctgcagtgtagtggcaagatcttggctcactgcaacctccaccacacaggttaaagcgattctcatgcctcagcctccagagtagctgggactataggcgcgtgccaccatgcccggctatttgtatttttagtagagacagggtttcacgatgttggccagactggtctcaaactcctgacctcgcatgatctgcccaccttgggttcccaaagtgctgagattacaggtgtgaggcactgtgcccagcccagaaaagtttgttaaagtttttaaggttttgtgcaatgtggaatcttaaatccgatcaataaacttttcattctttgttacattaaagcacagtggtctatcttacacatggagtgtatattctacacacatgcatgatttgtactctgccgatccactgaaagggttttgggtactcctcaatgtccttggaccacacttttgcgaactgtgttacagtgttttaatagagaaaaatttttaaacactcttgcattatacacatatcaaaaaaatatgatgactcaggactgaatattacacataagactcactccaaacacattttctacagtagattctctaattccgattgagctatgacctggctttagatttccaacctcagccgggggcggtggctcaggcctgtaattctggcacttaaagagaccgagatgggtggatcacttgaggtcaggaatttgagaccagcctggccaacatggtgaaatcccatctctattaaaaatacaaaaaaatagccggcgtgatggcagttgcctataatcccagctactcagaggctgaggcaggagaatcgcttgaaccagggagatggaggttgcagtgagccaagatcccactactgcactccagcctgggcaacagagtgagactccatctcaaagaagaaaaaaaatcagttcactgttaccaaaaaaaaaaaaaacactacgaattcagatagcatattaaaatgatttcaagataagtaataaaatattttctataatatttctttttgggtaagtaatgatgattttgacatgaagaaaaaaactcagtctgaaaactgagcagcttttgtgactagtctatccgcttaaataaaaatgaaaaaaaaaaagagcttccttttaatctatataataccaaaggtttttaccagtttgtaagaaacactagccctaattaaaagtaggtcacattcttttaggtgacagcagaatattgttaaaagaaaaaaataagcaaaatggggtttctgcaggaggcaaagagaatacatctgttgctcacagaatccaaataaacagcccaaacatgctgttcaaagtgaagacagtagaaagtggaagccccaagaagagttactactgtatggcagggatttagatgatgttcagccagaaatgagacttctgagaaggaatttctaggataaaatgcccagaagctgatctgatccacagtcagttgagaccggggcagccagaaagaactatacaagactatagccatattacatacttacctgtaactgcagtcatatggttttccatactctatgctattagaatacaaggagactcaggacaaacaaaactagcttgtcctgtttctagcttgagccacaggaaagtcttcttaagaccaagagtattgggagcaaatgaatgaaggttgttctactccatggatcaaatgaacttcctaattgtaacagaagagctatcacgaatgctttctcctcttcgaagacttccctgccatcctcaagacacataactgcctactgcttttgactttctaatacaacacttttttttcctttaacatgggctattataatttattataaagctgagctcttgagggcaggaatcttttcttttcttattcattttttttatcccaagcatgtaatatagtacctaccacatactaggtactaaataattataataattgtttcttgaatgaatgaatatccaaataaaatcaaaattagttttttttccagaatattatatctttagctttattttttctttctttctttttttttttttgtttgtttgtttgtttgtttgagatgtagtttcactctattgcccaggctggagtgcagtggcatgatcttggctcaccgcaactctgcctcctgggttcaagggattctcctccctcagtaactgggattacaggcacatgtcaccacacccagctaatttttttgtatttttagtagagacagggtttcaacatgttggccaggctggtctcgaactcctgacctcaagtgattcacccaccttagcctcccaaagtgctgggattataggcctgagccaccgcgctcagccagtactttgcttctaatgttttatcttaaaatgctaaattactttaatcttgttctaaaagaagttttgtacttccaaagcattggattccaaaacataaaacctccaaaacgtgctatacaattttccattcttctcaatctgccagtcttaaaatttgtttccccaaggtatccactagggttgaaattaaacatactatatattattttaaaagtcataagtttacttatcctagcaaagcgattgacatacaggtaattttcttttctcttttacttttggctgtagaaagcaggaaagacagagagcatcagggcatccttgcactttagatgcaatgacattcggtaaatcatacctcaaaatggtaataatacatcctgtttcaggctgttgtatggattacagtaaattcatgtcaggcatctgggtcatgttcagaatactatcaggccttttgtgttgttttttacatttcctggctagtccaggacagcatcatgtctcacttaaaccgctgcaatagcttctaattggccttcctgatttcacacttgtcaccccagtctccacaaaggagccataatgatgcttctgaaaatgtaaatcagatatgccacgctcctgcttaaccccatccaatggcttcccttggtcctgcctgttagggctgacatgaagactccaccccactccaatttcatctcctgacgtgacattcctactactacatcaccagcctccttgtggtgccttaaacatgccaggcacgatccagcttgggcccttcctacatctaaagatcccttgcctggaacgtgcttcccttcactttcattactttaggcctctgctcacatacttctttatcctctcagcctcattccagtcactatgttttattcactactatttgcccaagatcgacagcagtgcctgatacactgtgagccttcaaaaatatttgctgaataaataaataaatatattattgataataattccttaaaatcctagttagcatgcaggagaactgtaaaatcatgggaaaacatttttctttatcagaaacttaaaaataagaatagctaatatttggccgggcgcagtggctcacgcctgtaatgccagcactttgggaggccgaggcgggcggatcacaaggtcaaggaaacaagaccatcctggccaacatggtgaaacttcgtctctactaaaaatacaaaaactagctgggcgtggtggcacacgcctgtaatcccagctactcaggaggctgaggcagaattgcttgaacccaggaggcgggggttgcagtgagccaagatcgcaccactgcactccagcctggcaacacagcgagactccgactcgaaaaaaaaagaaaaaagaaataagacagaacttatttctcagtcagcccagacttgatagctcataatggtctgaggagatgtagctccctgtcttaacagaaactgtgtgaactgctcctgttcatcaatcatgtagtggctgtttactcgtccccaggccacatgtctctccacatagcatctgggtcttcccctcagcaaagccaaaatgtgcgatgacagatgaaatttctgcttttatttggatgtgaaattcaaacctaagttggaatgccccactgttggaaaacaaacttaaatcattcatgaggcataaattttatgtctagtttatccaattgaccaaaaaaaaatacatcaactatttaatgatcatgacgtaaaggtaacacttggaattatataaactatcattctctttctctctcaactttttctaagggttttcccatttacacattattttttgtccaagtgatcttactactttgttgagaaaaagggtcaaatgtagaaaataaactaaaatgacagaaatattaggaaaattaagaaacaataagaattatgaacagaagtgtttaacaaagaaaacattgtacagactttgccaattatgaaattaaatcactctggatgcagcaaggaaataaagagagaaattgatagagtagaaattaagaactaggttgattgccctgacaaaggtagctgaataactttaattctctgtacttcaaaagacttattataaaattaatctcaccacgtagattatccttccaactcaagttcattgaattgcggtgttaaatctgaaattctacctactacctaccagaataggattcaagaattccaacaatctctagaaaaaatatgcaaaattttgtgcagacatttaatattcattttactcagaaaagttgcacatcttatatgaatttttcaaggcaatttatgacccaatacaaatttagaaaaagcctattcaatagaattggcatgaatcattgatatttatatattttacacatataagtttatatggaagacaagttttgtaaaacataagaccaagacttttctttttgggacgaagccatcctactacctagaggaatgtctatccaacctctattagatggcagtcttaaagttgctggtttcagtcattttttgaaggaagagaggtattgcttctgatccctattctcttttaaaataacagaatttctaaaatggatgtcaataacccatttaattgaatatcaatgcatattaatcatgtttttcaatgcaaatgaaaaactttattaggactaaggcctgtagagaaactaaaaactaaaaggataatagtcatctattcattactcaaaataaaaccaattccaaaatgtaaagtccatgttaggaaacctaacataattgtattttaattattttttttgaaatgtatcaaataggaaatcatttaaaacaaatgtcctaggtagttgtcaagtttgcttattaagttgtcagcccttcttggacttcttttgcaaagcacaggtgaataaccatcttatttatggcaaagtaactgtcataaaccaaagactcattgactttcattgattcacaaaagtactaacagcttaaaatgtacccccaacatcaccacggccacctctgctgctctatagccaccatttattgagggctgactcaactctgctgggcatttcacatctgttttcttatttgtcctcacagcaacccttcaagaaaaatattgaactggagctgcattttagatgaggtaagcaattatgacatagacttccttcctgggatgaacacttttcctattacccatcccttctagagaaaggggaggactgatttaactttgtagacaggtgtgcaggctctgagatattttgccattctgctaacatactgactcttcagagggatcgattaaaaagcaattgagccacagaaccattggtgtcggcctcctgagtacagaagaggagggagctcattcaatcgtgcattatattagaaattagaactgatccatagatgaaaaagcaattaatatcctataggaagaagaaataaatactatgagatcagaagagattgatcctataatattagacctagaaagtatcttagcgactgtttttcttgcatccttcaattaaaggctatattttatatttctgtactttattatctactagatattttcaacatttccttctaaaagaagaatcaggtgaatcaggcactgtgcccagtttaacttgtactataaaagctggggtagaaggccttccctttgccttatataaaatacagaaaaatattagaattcctatttgcacaaggacaaacaatgattttatattaccttggcacttattacttatccaaagtcatgttagtaatttaaaatatgttttaaaatcttggatacagattagtacaactgaaaggtgttattatagagatcaatatagagcctagaatatataaagttgaaaaataaaacaataaaatggtatccattccccactatgtgagtgagttcaaatttatccattctcaatgagttcaggaatttcagtctgaaagaacaagtcttcaaggttgggaagacttgaaaacaaatctgctgaaactattactatggtctcaaatgattcacagagagcagaaaagaggctttaagagccgagatacacaagtgcaactgatctgaaagaaatagaaaataaattgtataatgacaaagttgacaacttggtaatgattttgggcaaggctctacactttgggccctgagaagataaaacagagtcatgtatcagattagtgattagtttaggaagctattaaaatttcttccaactctgaaaatatggacttatcagtaatagtgactagtttggattctctggataaacatgtccctagaatgtagaagggaaattccttggactaacatagcttaataattgcttgatagcagtacagccgagtagttaagagagttactctagacttgattaaactgacttctgctctgctacttattccaggttcataaaccattgtttgaaaccttaaagccagagattttgcaatttggatgttttttaactttagaaaaaactacagtgaatagtctatatattttattaacattcccagtatccaatactcaaacacattatttctacagtgactattcatactaagtataataaataaaggctttatatatcctcacctcaatttaggtcagattgtttgcctctaaaatagctcaagtctgtggagggtagaattctaaaatgaaccccaagtgtacatgtacccccggctgtacatgtcctttataacaatcccctaccctagagtgtgcgtggggccagtgaatatgatggacatcattcatgttacattatatggcaacggcaaagggatttttgcagatgtaattaaggttcctaatcagttgatattgagttaataaaaaaggagattatctcaggtggacctgtgctaatcttatgaatgctttaaatgaggatctagtagtcagagactataaggaaaataggctttctcctattgactttacagaagcaagccaccatgagttttacagctgccaaaaagtaaattttgccaacaacccataaacttggaagaggatcccaaacctcaaataaggtgataataggctgcctggtgagaccttgagccgaagatcctgtcaggtcatacccaattcctgacctatggaaactgtgaggtaataaatggccattgctttaagctgacaagcttgtggtacttggttatacatcatggaaatgcatggtaattcaatccaaggttagatcaccttttgttaacaattagttacaaaaacattttagttcttagagatttctgaattttgaaattgtgaataaggaattgtatgcctgtgattgtatgacttcatgaagtatttaattgctatgagctttagttttctaatctttgaaagagaggcagtaacaacacctacctcacagggtggtggtgagaacttaataaaatagtgtatataagatacttgatataaaacatgaaaccaccatcccactgcaaacgttttattattattattattttctaccctttgctctaaaccagtgatctcaacactatagctacatgttaaaatcaccaggacagctttaagaaatagcagtgcctgtgccccactccatatcaatcatactgggatctctggttgcaagaccagtaccaatgcagttttaaaagctcctaagatgactctaatgttctctaagaccctaagatgactctaatgttagcttgagaatgactattccatatatgtcacagaaaatcttggctttttaaaaaatttggtagcatttaatgggttttctgaataacaccatcaagaaagggaatattcaatttttaaacaagctttgccctccactttacataatgaattctttccattatatatccccattagattagtctagtagatatgggtttactaggtagcttcttacagtgtaactccttttggagaactgacaaatcacaggcctggctcccaaaacaaaagacatcaaaccttgtatcccaaatgcaccaaacgcaaggccctttcagagcacctcactttccttgttccctgcataatgctccacttgatttctactctaatgagactgaagatagaatgcacactggtcaaactataaatagcagtagaactctgacccacaatctatgaagcaaccaacctagaaagacaatttacacagaatagtcagagctcgatcacagactgccaactcccaattttattatttcttatttttttggtctctgcttccaactcagaaccaaccagaaaatctaatatgctcctcaaactaatcacatacctagttcacctcctaggtgaactagttcatgttctcatgccaacaatcccaatcagagcacacgtagagccttctttctctgcctttcccacacttctggtttactttttttatttttattttattttattttattttaatattgacagggtctcactttgttacccaggctgctttcaaattctgggctcaagtattcctcccttcttgccctcccaaagtgctgggattacaggcatgagccaccatgaccagcctcctgctttactttgagtctctaccaaatgcatgtgatgatggctgctatggaaagctttgaataaactgctctaatttgtatggttttatttataattgccacaaaaatgtaggtgaaggaggaacatgttcttataagcacagctccaattcctgttacacatttttatctattcatgtaatttaactgtgaatgtttaaactttgtgttggagtataatatccagaaaagtgcacattaagtataaaacttggtgaattttcacgaactgaaacacctgtgtaattagcaccaggtgaaggaacaggttgtgactagagtccctcctttgtgctcccttccaggcaccacagcctccccaaaacaggtgaccactatgctgacttctaacatcacagagtagattggcctgctttatatttaattgaaatggaatcagagaatagtatccacatttggtgtctagtttctttcattcaatgttatgtttcagttttgtccttacttttgtatgttttccttgcaatgtgacactccagtgtaatgaatgcttcacaatttatattgggttgtttctagtttggagctatgaaaaattgtgatgcagtgaacattctagtacatgtcttttgccaatctgcacatttctgctggaaatgtatctaagactgcatatgtttcactttgataaatataaaaattattctttaatttaaaaaaacgcgcaagaatcatgtattggtcctcaactaaaactgaagaaggaatttggtagccaaatgggtgcaacctgaatcctgtattttctttcatggtaatgctattttaaaatattgcattaaaaatgtttatcctacaaaaaaccaacattgcagatattatgccattttcatttcttctagaaatacacagactatcttatgtaaaaggtaatttacatctactggaaatatacatatctctgagaataccagtataagaaaagcatccttggctttctttttgtgtaatataaaaagagaaagaagcttggattttaggaaggcttgaactaagcatgacaaacttctcccttatataagctgcttgaggcaggcgccaagtcagattcatctttatagtctcacatctgtacctctgatacatgaagggtttggctcaatgtttgtggaataaatgaatcctcaaaaagccatgtcagcaaatgttcctcttgaaatgttcttttaatgagctggtatgacacttgataaaattcattaaatcagacttcctcgcccttccttttgttgtttgtgcttcagagctcagcactgggaacctgccctcaagtcctccccttccagggaaggctggaaagggcttgaaccaaaagagaaaagaaagcaaatgtttacatttacctgctctgggaacacagactgctcacctcagcattcaaataagtgccctccaaccccaaggtgggatggagagagatcctgttgtattatgaatgttgctactataaggcataagaagaagcaataggaaacacagttgggccactgaatctggcagcttccagaggcctcagaacattcacatttgcagctgcattaactgtgcttgtttagtagctgacattcaccattcacattttcaaagagctatttagatcgaatttcaaaggtatgttttgaggggaccaaacacatagcaccatggtaagctacctcaattttgtagatttttcataaattgccattaaaaaaaatcacattgtatagtaagtagaaatcagcctcagaggaaaaatgtactagatcagatttttttaaaaactgcccttacatttattatgcactttccctcttcacctcacccatcccatatggaaagaacaaaatcataaaaacattaaagaaatagtatcaccccaaattccaccactgtagcccgataaatgtttacattttttcctaattcttgtaaagtctttgttcaaatgcacaattagaaaaataatggtaatcatgatattacaattgatctgaagtcatgttatgtcatagacattttacattttactcttccccaaggaacactgaccatattataaccaagtcttcataatattagtttttaaattatgtaataccctacccacaataaactgtcattctattttattactctgtgacattttgaccacagaaagatttttactattccatctttgtggctttttagtatttttcctacttttaaaattattttctgagaataaatactcagcaataggaatacgagccaaagagtatgtgtatatttattgtttttaaaacaaatttactttccaaaataatttttgccagttttacaaatttaaatagtcagaatactaaaatgtgaagaaatagcaccccaaattaggaaaccattctaatttggcttatacccatcacattgctaaccaccatctataaagatttgtctggataatgctttcgttaaatgatgcatattttaaagtaacaaatgttcgcctttttgtactgctggcaagtcagaaaaatcatccattttcaacagtagattgaggtaagatttccatagagaaaaagagtaaaaagctaaacttagttgaaaatagatcatatgccatagtttgtactatgggctttctcagtatcatctaatttaatgctgcgaagtaaataataattgcccctgtttttacaaattgagattctaatattaagacttggttggccgggtgcagtggctcacgcctgtaatccaagcactttgggaggccgaggtgggcagatcacgaggtcaggagatggagaccatcctggctaacactgtgaaaccccgtctctactaaaaatacaaaaattagccgggcatggtggcagatgcctacagtcccatctactcgggaggctgaggcaggagaattgcttgaatccgggaggcagaggttgcagtgagctgagaccgcgccattgcactccagcctgggcaacagagcgagatgtctccaaaaaaaaaaaaaaaaaaaaaaaaaaaaaaagacttgcttgaggtcacatagatttaaggtaaaacacagatcaggttgtttctactaaaacattctaaatacataaaaaattaataaacgaattacacagatactccaggattgccttcaagcagacgtgtccaaacgttgaaaatcagctagcaaatttcttataacggggaagtaattaactgattatttgggagatactgtactttttctgactttgggttaattataaagaagaatcacttcataaaacttatttcaggtgaaagaattaattataaagtgttatatagtgatggctacataaaactatatttcaaacattattttattcttgacatattactattttcacaacatgaacatttctacaatgttccaccagtgttcacaaatattattttcctcttttttgtcagtttattgctgaaaaacagtatacatacagaaaagtgtataaattttaacaaggtaaacatattcatatgatgcattcacatcaaaaaacagaaattaccattatcccagaaatcatgcttttaacaccagagattagttttgccttcacagatttttttttcatctagcaaagctctgataaattctgtgacctttattgaagtattcatttaatttctgctacctcttccatttcttccctgaagacagaagtttatcccatgagatcaagtgaagtacaccagatgaaaatagtaatatcaaattggcactagtagggacaacctttgaatacctatcagttggcgcatactatacaggacctttttttttccccactcttacaaccacatcaaaactaaaaagattatgtttccctaaaacaactcgcagagagtagttatatttgcataacaggatttattcctgcttagttcactaccatctgttttcatattttaagtcaaaagatttatatattaaacaatcttatatagcttttcacatgctattttagaaggcaattggcccaaatcctgattattttttctaagtatataaagttgtttccataggtaggatacaaaccctcaaactcaacatctttttgatataaataatttaaagccttatcacaactgtgaaaagagccactacttatcccatttgtgataaattattaattgaagtatgcattcaaatgtacacttcctgatagcaacttctttaatccttatgtagaacataaaacactaaacaaaggagaaaaatcttcaataatttacttttctctgaaatttacatttctctgaaatggttcaagatgcttcccctaatggaggataaaatgaattatgtgtggaactagataattattgtaatgaaaatgttaggatttaactatcaaaagcacatacataatatatgctgtgtcacatcttcctatattaataggttttaaatattagattatttataattaagattcaacaacctaaaaaatatattttttactaccttacccatacatctaaactaaaatgtcacagagggtagggtaaggaaagtaattatgcagatgttattcaaatcagcctgaacagttacctatttacataaaaaattggatgtttgactttatgttgattaaataagcaactgatgtctttattgcctctgtaacaattttatgatttttaagccacagccttagaattttcaagaatatcactttagaaaaaaaatagctattcttccatcttgacaactttatatcatttaaccacaagggggccgtagctatcttctttgaattgtttaagcatgccaggaagcagataacattgaaaataaaatcaatccattctcaaaaattaagtaaacataagaaaacaattaggaacatacaaacctgatttttgaaagtaaaatgaatatgaaacacatgggttttccccatacatgttacacatttgaagcaagatacttttccctacttctgtctccaaaacaggcgtatctctgtaccttctgaactcacaacagacttctaccttaaacagaattagtattaagtatgatcgtttgtgagaattattaataaagccactattgttcaagtgctgcgatttatcacttgggaaataataaatgcacctccagtctgtgctaacctgatgacctgaggtgaaatttgagaatgagtaaaattaccaaaatatgctcccctggctaagtgagcacactaaaaaaggaaaataacatctaacaatgatatgcttaaattatgttctttttttttaaaattaaaattacaaaacagttggaatggtaaactatacaaagcaataaacgttttgttcaaatattctctctggtacattcggcaaaataaactcctctctgcagataaaaatataacatttgtcttctgaaagaaatattccacacaagtgctagtataaagtagaactaaaccagctgttccacctgtggccctgtgttaatactttagtgccttcaaagatgttatccagaatcctcaccaaaggcaaatgaactttccctgatgggaggggcaggctgcttctaaagcactggccacattatgaattcacactatatccaatgatccttttaaatttccagtcgctcatgccatcctcacattatcactttaaattttgttataccaaggaagcaaaatgttgataacagtaataataaatgctggaataacagaagtattcatccttttaacaatattgatgcaagttcttagactcttctaattttaaaatttcatgccatatctttcatattcattctcatgtttttataatatctggatttccttcattttttaaagatttttcctcaaatgccaagcaccattgtctaactactctggtggttggaggatatttcggctttgagataacattatgacaagccaactggacaatacagaagaggacaagaatggcctggatgtagtcctaaaatgttacagtgtatgaaccccagtaatgtctctgtactaaggaaatggatatttccatgactcattcccctcattcatctaatggaaatgtactcatcacctgctctatatgcggatgactatgtgcccatgaactgtggaagaggtatacataaattaagcctattaaccctccccatattcttatgtgaaaagccaaggagtgaacagaaatgagtaggctaacatttggcaaaattctcagttacacagcacttccttgtcgagggaaaccaatatttgaaaagaaaaagcaaccacggagaagagaaaaatcctctctagaaactcgtaacaagttaccaataaatagcgaattatagaatgtgaaacccaacttcctaggccaaatgttattttctgcacaaattttaaaagcctttggatccattctgttttagggtggcataggctcagtccattccaatggaaaccagagggtgattccagggcccaacctatattaaaaacagtggtagtcaatagtataatatggcatctgtattccaaactgataggtactctagacatgcataactaatgcacaacaacatctctcctacacgtttttcaaaagaccttcaacaagttgcacttgacattcacaaaagagcacattccctgtgatagtgctatttctctctttagttttaaattaaatgtgacattcataatttaatctcttcactagtcaaatgtatatcagaaaaattgacttagagtaagcattttcttcactgattaatattagaatggagaattcaaccaaagctattaaaagcttttgtccctttcttattagtagtgtttcttacattgagctttttataaaagcctataacttgatataacaaaagtagaagaaaaaacagtatttttaagctctatttcaccatgttcttaatatttcctcacttacggcagattttcatgccataaaactaatttaccacctactgtaggtgatattaactctaaattttaaaattgtatgaagactgaaataaaataataaataatccaattactaggaacttactaaagagactctccttcctcaaccatggttaaatccatttacatttctaactcagtattttaatccaattataaataaaaatatcctttaatggatccacttaaatcataaaccagcacttgtaaaattaaaaattaccacagtaattctataacctggtacttatttaaagtgtcttttttaaatagctgggtatttacccaacccttatataaattatgtaaaaagtaaagaccagaaaaaaatatgttctaaattctaaaaaaaattttacaagtctcccactcttaatacatttcaaaatactaaactaatgataatcattttccccctgacattttcaatttgaataaagacaggaaataaaaagacagtctaataactaaaacttctaaagctagatcagcaaatttttactgaacataaggcatcagagtgatgtgttattggcaaaacatacagacacacacacagatatatacttatatcatgttttctagattgttttttttcctacctccaatcttctgtgattttgttctattgggctatacatcaggtatgactaggttgtctcaaaccttattcgtttaagtacttcttattttataatcaaattatgggcaatttataatctcacattaacattttgatctaattggattattttctgaaagcaaagtacagattgcaagctaaaacacacattaagtataagcatttgcaaagataggacagagagtcttgaaagagcttaatttcaatatgctataacctataagtaacttacaaagtgtattcaaatatatattcagtacttcactatgtgttggtcactatgttagttgctttgttatatattaaaaagaatcagatacaaaggcatcaaaccataaaacacattagcacaagttatatgtgtgcaattagtagcttacctaaaatctaaagatgtcaattaaaaactaaatataaagaataaagtacagttaaatgacataaacattactactcattactgttactcatggttgcttatagttacacaatatttttttccacacactatctcatatatattacaatccaatttcatcccctcaacatcttacatgttaaataaaatagatactatcttctattgtgaatgaggaaatgaaaagatagaggtcctgaaactttgtcacacagaaaatcacacaataaattcatataagaggggaataagatttaagttgtctgtcttctagtagtgtcccaccactacctcacatgtaacatacccacactttctcatgctatcactagcgaggggatttatgctaaccttttgaatgtgttcttatttttgacgcctcaatttgtgaaccaatcatctacaacataggggagaggcaaaattatatcacacaagtagacattcgcaaacacataatgaagttactaataagtcacattaaaaatggtcctattaaaaagtgaacaaaggacatgaacagacactttccaaaagaagacatatatacggccaacaatcatatgaaaaaaagtccaaaatcactaatcattagggaaatgcaaaccaaaactacaatgagataccatcagaatggctattattacaagtcaaacaataacagatgctggcaacgttgcagaaaaaaaagaaacgcttatgcactgttggtggaagtgtaaattggttcagccacattcagtagtaactgatctatttgcaagaagaatctatgaggttttttgagaagaggaatcttggatcttgacttagacacttttgtatcgtcagtgttatctgtatgtctgttacacagaagtcactcttaaatgtttattgaaatgaaaactgtcatcacataatgccacacctagagttggctctgatggatctgtccttgcaaatagactagatattgcttgggaataaacggggcaattggattccttcattttattattctcaaaactaatcacaatatctgacccaagatagatatgcaacaatctttattgaatgaaaataaaatcattgagtagatgaatggtatattgggatatgggcattttgaggtaagtaatatattcaactgatgaaaagaaaatagcaaccaatagaaactagtaatgactgtgcttatctttacaatgaattttagttacattcatttctccctttttctctaatatctttaagaaaaacagaatattattttagaaatactactatgccaagaaaataagaatatgaatcagtacgctcattggtaaatggctagatcttattgcccccaaatggcaaaaacttattcaaataaagctatatatggaaccaatacgataaatttggtggtgtactgttctaaaaaaaaaaaaatcaagcctctatgaaggcaccataaggaaatcagaattttagctccacacaatcatgatttgacaatactttttaaatactcagcagaccccacgtccctgaaaaaatcccaccgctatagtaatgcttccacatttccttaaagtttctcattagtagtgataacaatagtaggtaaaaataattgtgctatttaaatgtatttattgcagtaaatttattgttctctttaagaagcactttgcgcttcaaagcttttcactagaaagagacaaggaataatattatcaatatccatcataaaaatatcaaagcccctatcattaaaggtagtggaagagttgtccacagaaataatactgaagcctaaattgtcatgtagcctaaatgtctctttttttcattagattaggagtcaactgcattttcctgactagtgaattactttgtaaaaggctggaaggccccattggaggtcattaccctatctgcagggtctactggaatttgactctgtgcttctgatgtgtatacatacacattaccaccccaacaatgggactcgttttcaggttttctacacatttatgagatctcagcttataagagtgctctttccatggtctatggtaaaaagattaggacattaagtataaagaagcaataaataatgtagatgctatttgcttagctaagaattgacatattagaaatgaatatagcactaagattattgtgcaaaagaacagttatgaactacaattttagactcactttagggcatctatggaataagaaaaggatccttgactttggagtcatacacacccacgtttaaaccccatccctggcactcaggcataccagttgcatcactgggaccaattaatgtctatgagccttggtttcctcctcagtaaaaataacactactgaactcataagtttattttggttattaagtaaaataatatctctcaaacaaaggaaaaggatctcaatctatgttatatcccttcatcttctccattctgccatcatagataagctccagcaggaattgaatttcaaccctgatctaataatctcattttatattttggatctaaatctattatgtgagtttaaaaaactattagcctcctttcataaggacatgaatcatacattgagttttaaaatctcaaagtttagaggcaaatacaagtgtattactgacttggcagtataaatacatcaaagaattctcacaaaccgtatcttttatattgctttatgtaccaataattcatcaactaatttattttactaaattcttaaaacacaccacttatgttttacttaaaaggtaactttaggccaggcacggtggctcatgcctgtaatcccaatctcagcactttgggaggacgaggcgggcggatcacaaggtcaagagatcgagaccatcctggccaacatggtgaaaccctgtctctactaaaaatacaaaaattagctgggtgtggtagtgcacgcctgtagctccagctactcgtgaggctgaggcaggagaatcacttgaacccgagaggtggaggttgcagtgagccgagatcgtgccactgcactccagcctgggcgacagagcaagactccatctcaaaaaaaaaaaagcaactttaaggtcttactttaaaggtgtcataaagtatagttatggaaatattttacgattttaactgaatggagagtatacaaacctagggatctcactcagtccttaaatcatctttgaagtggcatcgaattctcagtgttaaaattctaccagttgtatgtaggactgatataactcatgtgtattaaaaataatttttaagatttcctcagtagttatgaccctgattacgaatcagacacctttgtaagatttactaatagtttacattaacagattatcacttattaaaaataaagccatgtcttcctatttcagtatttgacctgaatactttttacttttctatattttattctctacaccacaaggtaactgcagagagaatagtgctaatctggactatattttgcattaattcagggacttttgaagccacactgaattgctttttcagacctgcttaaggtcagacagctgaggaaaagccaataccccacaatgaaatctcaaacatcctgggaatactcacttcaaatctgtgggatcaatttggggattcatgacaaaaggagtcccaagagatctacttataccatcaccatctcacatttcagatcctaatctcctaattattctagagtgcttgatggagaaagaagcagaggggggaggaagagaaagacagtatgtatatgtttaaggatgcatggaagggagggaggggggaattaggtcagaagggttaattctgggcccagtcacatatatgtaattaatttctatgtttagtgcaaatacgactgtatcaacagtattaatttaatataatggcaaggtaagagcaggaatatatgctactatttttaattcctaggcggtaaatttgtgtcatttttcacagtatggtcctattgaaaaccttaacacagagaacatattactttctggactataagagccgactgatgatgacacctcttgaagtctatttagccatttaaatattaagcttttaaaatcattctccaataaacttcctaaattgtttcactcgcataagaaggataaaatatatcctcaaaagaatgctatgaggcttgctaagagggggaaaaaagtgaaaatgcctaatggcatacatgacttaggttagggattagttgacattatgtaaatctgaatatcattaaagtaacagtaaatgaattttatcgccaagagtaagaaccgtataagggagcgtataagaacagtataagggagtgtacaatacatcatactaaaataatttttaatacaatatattttaatcaattctctagcctatctgagacatattcagaagaaagtaatctaagatgtaaaactgaaaaagaaattaacacaaagctaactatatggagcagccacagcagttctcacaatgtgagaataaacctgttaaagtctcatattcaacttcactacagctattttacctttcagtcaaacaaagaatttcatttgagaatcttaagtaatctatactcatttctaccagtaagattttctggctgcacattttcaaatacagtcaactttttcttgctcatatgctaaccggcattcagtcttttatagcagtaatcactgaaagaacacacttctgtcaaatgcaagagatcttattcagaaaatcgaataacacagaagaaatattcattatatgatatagaaaattttccttctccaaatagagtcactgcattgatttttttcttgatttgtttgttgtctattacacacgtctacacattccaaatcaattttatgagtcagactcaatactgaatttattgcagaaaaattaaatactttgtaagagcaagaaaaaatgtattttgtttacattttattaaaataaagggtatgccttagaatcatatttagtgtaatggttaggaaataatcattgtaccatgaaagtttatcttgttttaaaaccataaatcaggctgtccagaaactttttaaagtattcaaaaactgtactttcaactctggacagtttatgttatcaaaacattttagcatatgttaaacagatatttgcattccaaatatctgtttaaattctgtataaaaaacattttaaactgaactgttctgatattttgttttataatgaaaccaagcctttaaagatggtgtataaagctaaactcttctttaacttttacctctgttttgtttcaagttctctccatcctgctactgcatgctccactatcccacccttcagaggcaccattaagaaacaatttttattttcatacaaatttctaaacaagaaaagaatcctggctgattttagctacagatcctttaaaattcaattctgcagtagggtttatgccttataaatattttttaaagatggttgacatatgattgactcttatatttttctacaatagagacacaaaattctcaattatacccgagtaactatccaaatatttacttgctattgtgagtagttaatattaatcaatttgttataaaagtaaccaacaatgactaaatacttgttatttgacaagcaaacgtgtttttgttttggtttttacacatattatctcttttattccccacaacaaacccatgaacaaggtgttgtcacgatcccccttcagaggtgaacaggctgaagtacagggaagccatgtggcttacctatactcccaccatgctacatgggtgcagacaaaagaaaacacatgtagttttcttactacatgtagcgaatcccaaattcttcttctttattctatataacctaaaatagtgaaattacagaactatttacatttagctctaattttgaatttttaaaaatggttagtggttcttttacttaaaggtcaaaatttccattttccaaggtgaccagaaatctcatactgccttcataaagaaaacagggaccaaagacttaaagattttctgggctgagctcactctttctttaacagattaatttagatgtagaaactctttcaaacttcaccttgatttgtatctttaagtgagaggggagttttcattcattagttaatgtgcacattaatgagataatttgtgggttttattatttcttcaaagacattaaacttctcaagggaaaacatttcatggaaacaacatgcattcttgttattaaaattttcattttaatctcgataaataatacttcatatgtagcttcatttattaggattttaatcagcttttaagttcaaatcctttatgacactaaaggatgagttatctaaacctacccagaaatcattttatttatcaagggcgtttctataatcccataagacaaaacgaaggaagtgagcatgaagaagcaagaaatctaaaatattaatcatattgcattttaaaatgttctttgcagcctcttttttaggtgtaaattggatgtttaggcttagttttggttttctacagtagaccaaacagtgctaacctgtgttaaactgaatcaactaataacttctaagaggtatgctggaaaacaagtggaagtgaaataatatcatgacctgacgtcttaacatcagttaaaataaaaggaaaataaaattaagcaaggggaaaaaaagcaagcaaaaaaacaaaaaaagcacagaatggttatgattacaaaaataatcaccacacaaaaacaggtcacatgaaggaaaattattctcaataagaataagcctcattacttaggaatccttgatacagtgtcctctaaaattttctccatggacagtagtgcttaattttttttaagtatcatcacatccttcatgtgatgtcactaaggccatttaaaaatctgtttccacaatctttccctaacagtcccaactttccaactttaacatacttatataaacacaactactagtattattttaaaatgcataattttaaccatattccactgctgcagacaattgcaatgtgctttccatcaaaatcacatgaattatacataggaaaaaatctttgatcattactgcctctcacacttgggaaaagtggaataaaatagatgtagcaacagctcagagccgattttctaacaaagcataaagcttcctccaccatatatggagcagcactgacaccaaacaagaaatacaatgtcttgcttgcacagcaattctgtggcaaacactatgccagccatggaatattaaggtttcataatgtcagtgtctactgtcttcctcacatcactgtcatcacaggtgaggcaaaagtctctgaatccccttgggcttacagcttactctgccctgcactgatgcataatttgctttggtcttgaatacatccctggataattctttattcttgcagaagtctcccctacacaattgaaattcgcctttaatggtttccaagaggacagaactcctcggtttggtgtttccaaagatgcaaaaaaactctaaaaatggagtaactaaacacagcatatgataaaattggtgagattatctgttttatgaatacaaaaatacaaccccaaattttcctagaagactttcgtaaatattcagtaatctaaaatgttgtaaattgattgtccagacacacacaaaatgtctctctctctctctctctctcacacacacacacacacacacacacagaatttagaaaactggttagttttgtaaaattcactttaaagggaagattgccaattctccattttgatctaggagaaactggtaacattaaagatacatgtatgttatggtttcttataaaagtcatggtatcttcaccttctggcgtaacataaactattgatttatatttaaacattctttcaatgatagtttgtagtttattataagcatttaacttaaattttttctatatgacttcatagttatcagtgacctcacctcattaaaggtctgacattctattgtctatgtatagagatcatttgtattctgtcataataatcccttcatagacctaaacctctgtgtccaagtatcctaataaattgctaggttttttaaaagacaccaaagaatattcatttattttataaatgcctcatgtttattgtagaaaaaaaactagaaaatactgataagcaaaataagcaaatactctatagcccgctcagttaatatcttaagtactgtctttgcatatatagatatgtatatatctatatatatatctttatatatttatgcatatgtagagatactaatatatacatttaatttatacatatcacattaaaaatatacttgtgcacctgttcttgctcatatgatagcagaaagtgaatgtagttcatctcaataaatatctggcaccataaacagatcatatttcattaaccaatctactattatttgagaactgaacatctaagaaacatcatagaacatttttggaagtgcatgagaagcatttaattttaataaatactttatgagcataaatgggacaaagcctcttctttaagccctgtctgatctgtgagtgtatgagtgtaggtgtatgtgtttgtttgcagagtagggagaatgttgaagggtagggggctaagagaagaaactttcttctttgatcagctcacaaatggttgagatacctatagaagttcacccaatagctagttgttctgtaaaagtgttttacacttaaaagcaggaatattcagatcattctgaactttatgaaaataaaaaactatatttggctgatgatatagacataggcatgggtgtgagtgagatggaatttaggggtccttttggttaaattctgtcagtattgtatatcaacatattattcattcttacctctctccccaccatcaccccacaaatacacacttaaagaagacaccccatatctagggtcttcttccacttctccaggtccattgcttatccaccagtctccagctttgagaagaagggaggtcaaaatgtgctggacagagtccaagtagaagtcttcagactgtcagccatattagctagctttctacttttctaggtcttttggggattttaaaatagaaattttgattatgaagtggggaaatacaattacagtaagtaatgtatttgacagtaaaagctttaccaatattctttctattgtatttaacacagatgtatggctctggaaatgaaaatagaaagacccaggctaggcacagtggctcacacctgtaatcccagcactttgggaggctgaggcgggcagatcacttgaggccagaagcttaaaaccagcctgggcaacatggcaaaaccctgtctctacaagaaatacaaaaattagccaggggtggtgatgtgcatctgtagccccagctacttgagaggctgaggcaggatgatggcttaaacccagcaggtgggggctgcagtgagctgacatcatacccctggactccagcaaaagagccagaccctgtctcaaaaaagaaaaaaaaaaaggaaagaaaatcaaaaggcccaatccttctcacaagacccactgaggtctgtccaaagtaaatccaagcatgcattgctgaatcagctagtgctttatcatgaaaacacaggcttgttttgatttgatgacatcaggttgacaaagtcattttttaaatattttaactacaaggaaagagcctccataataatttttatccagtttttaaattttccttaaaacaaattaaactggtaatgttttaacattatcaattcactattcagtaaacccaaaatttggaaagaaaaaaatactgtaccacaaacaaatgtgaattctatgaaatactgaaatctgggcaggggacgggcgaagtcccttagccttcctaacaaaaactttaatatctgattagaacaagccaagttatccctattttagggaaatgaaaccaggaaataacacaaatgccaggactaagcaataggcattaaacagccagttatactgccacctatctaccacctttaaaacactgggcatgccaagcacagaacatctgcagatattacagaggctccagtggtaactctactggagattttaagttgccataggtcacaactatgtgtataaataataacaataataaccataataaaatgataataataaagtacttcatgcataaggttaatgatgcccattcagcaatcaggcattcactttgactgttttttctaaattgttggaagatttccatagatccattcatgtctctgtgacggttcttttccctaggccctctttttggaagactgatcattggagatgaaggcccttctgctgacctgagaagagaggacagctctttaacccacacagaaactacacccaggggtgaccccatttgaactgtgctgttgattttcccaagcacattgtttcatagtcatttaaaagaggattttaataatcatgaaaatatgaaagagaatattaaaatccaagagttttcttattcataggctaatactttgaagaacaaagtgatttattttcagacaactgaaagtaaccttgcaaacccaagtaatatttttcttgcacctattgccaattgaagaataatttttccatactttgagcacaacacagaatgcagctgcatctcaaattataaaacagagcattgatgcagtagatcaaaatcctgctatagtaccattggggaagaatagatggttctttggacacagtgatcaacaaacacctatcctaaacatgctctaatgagagaaaggccaaaaaaaaaaaaatgccctcttgcagctgggcgcggtggctcacgcctctaatcccagcactttgggaggccgaggcgggcggatcatgaggtcagaagatcgagaccatcctggctaatacggtgaaaccctgtctctactaaaaatacaaaaaattagctgggcgtggtggcaggcatctgtagtcccagctactcaggaggctgaggcaggagaatggcgtaacctggaaagcggagtttgcagtgagctgagatcgcgccactgcactccagcctgggtgacagagtgagactccatctcaaaaaaaaaaaaaaatgccctcttaaaattcaacatagatgttttcccaaggtgtcatgggagcacaaaggaggagcaccatactcagtagatgtaaccggggtaaaagacactaggaaatacttcaaagagacagttactctagagttgagtcttaaggaataaatgttggctaggcattcaaggaatataattagtcaaaggattctgggtacatggacttgtagaaaaaaagacttaggataaaataaaaagcacacaataatccgggaatggaattctttgcaggatcatttggcttggttaaaaagcaaatgtagggaacaaacaaaatgaggctgaaaaggtgttccagaaccagattatgaaagatcattttgactggctaaagaaagacatttccttggttcttaacttcttcatatgttagcattatctttaacacatcatgttcagcattgctaacctcatagttacaaaatggttggaaataaacctgaaatcatccttttcatccgtccagtgggagaataagggtcatattctcacaaccatcaaacaataatactgaacccacctattaaaatacccttgatgtgatctctataatcatgcacgcatgttgtgctgattggcttagacagattttatctcagtcctgaaccaatcagaacctatccctgaagctgggcctaggatcaatcctacataatcctatctacattttatgacagttacagtatgagagttttgagaaggggggaaataggaaaatgattggtgagtaggtgtcttagtccattttctgctgctatattagaaaaccatggactgggtaatttataaagaacagaagtttatttggcacacagttttggagactgtcaagtcccagagcatggtgctagcaccagcgagggtcttcccatggtgaaggcagaagcaagcaagtaaacagagagaggcaccagtggcaggatttgtaataacccactcccatgataactaacccattcctgagacattgacattaatccattcatgaggtctccaccctcattgcccaatcacctcttattaggctccacctcccaacagtgctacattgggaattaagtttcaaacataagaacttttggggaatacattcaaaccacagtagtaagtaatgggcaaaactgtctctactgctcttctgcaattctcctgcattttaaggaagctttataatactacgtggagagagaaaagcataatcctataaaaataaattctcattgtaggaaagcatttttgtttcttaaataacatataaaatcttatataatttcctgtggatatatcctgaaatatccttttaacttcatcacataagtaggtacatacaggcaattcttagggatctgcacctagtggctttaattatcttttctctgaggagattcactattctagtaggagtctaagcttctattgttattgcttaagcaataattttatgtgttagctctcaaattttaacaaataccaacttctaacatcataatatagtaactttattttaatttaatttcttacttagcattttgcttttagtacatagcattcttccaagaaattaaataatggcccttttgtctgttcttcttttcttgaaaagatttcacaagagttctggtttactggtaatttcaaatacctgtcacatgaaataattgctttctatcactagcatttttcccagactatcagcaatcaaaaatcacttacagtttgccacaagaatatctcaggacttgatttgtatcatttttaataaccttttcccatatattttcaaaaattagagagtctgttgtacatatttatctatttatttgaataaataaagccaaaaactataagaagcagtcatatgacacataacaagtcagatatctgtatctgtattcaaaaatcttctttaagcaagggaacataataatgaatgctgttctcatactctcctgtatctcccatctctcaacgccatgatgtaataagaagttactgaacagtattaaagccagaaatcacctgcttctgccacttgtataatttccacatttttaaaaagcctgtaaaatgatcaattcactaccacctaaaataggttgctgctgtgatatctgaaaacagagattttaaatcctgtactaagaacaatcacaaaaagagacacaaaactatgttttgggtactggaaattatctatatcttgatagtaatttgttatacattgctgtaggcttctgtcgaaactcactgaatttcaaacttaagatttgtgcatttcattgtacattcatggtacctcaaaggaaatatttacatacacacatatataaaataatttaagagtacaatgtattatcattgtgctgtgacaactagatccttgtaaagcaattactccactggttatctgcccaaggacaatatgggtgtgaaaggattaagctgtaatgcttttttccgttgcttttctaggtatgtaagtgatttgatgttattatgccctctgttcttttcattttcagagccatacattgaaaatctttttccagctttgtgtatgccatacattagattcattagaataactcccaattagaaaatatcaagtagtccattagtggttacatagcttggaaggagcaggagataggatgcaaatctggacctatctgatgacacatccttagcttcccatgggcaacctttaacattttttgtccataaacagttatgagtcgcagaactacaagggacatgcaagataaaaagcctagtgattatcactttatttctctatgatatatgtactttggaataccccaatctgtgtctttcaaaatacaagagatttcaattttttatgtcatttactatattttatttattagacaatataacaatgattgttttccaaaaacatcctaccctattcttcttgttttaaaatgagaatgcgagtatgctttgcaaggggcaaaatagaaactaaatttcagtaagcttcttccctttgcaacaataataataataaacatttatttgagtgctgatgataggccaagcattttgcaaactgcttgatgtaatccttacaactatgctctgaggtagttatgcttatagcactcatttttccaaagtaaagagaggtgaagttacttgcctttcagtaacagctaatgagtagtggagccaatatttgaaaactggcaggcctgtctggccttatcacaactataccatccatactctcttaattaaacatgcattggctcatttattaagcatatatttattgaatgcccgctgcactcatcagtagagacttagagttcctgacctcaaggagttacaaaaatagtaggtgttacactactagaaaatgtcactgccatttgataagaactatgctatttaagcaagaggaggaaacacttggccgggcgtggtggctcacgcctgtaatcccagcagtttgggaggccaaggcgggcagatcatgaggtcaagagatcgagaccatctgggccaacatggtgaaaccctgtctctactaaaaatacaaaaattagctgggcgtggtggtgcgtgcctgtagtcccagctactcaggaagctgaggcaggagaattgcttgaacccgggaggcagaggttgcagtgagccaagatcacgccactgcactccagcctgggtgacagagtgagaattcgtcagaaaaaaaaaaacaaacacttaacccagacacaaattgtggtagctggcagggtggattgagggagagataagagaggctaaaacatacgaaggttctgtggagaaagcccaattttaaagaatgagaagttaaccagctgaggaataaaattaagggtgtccaaaggtcagggcacaaagtgaacattcagggaaatggaagtgtgagtggattatagagaggaatggctggagaagaagggcttatactggatttgactttcaaaataatttggatttcataacaaagagaatgagaaaccattacagaatttgggatagaaaaagtgataagttttgaatctgaaaaagatgattggcagtagtatggaaaatgaatcaaatcacagggctgtgagaatctaaagcaagaagacagaaacacagaccagaaatgataagcgcatcatgtgaggcaggcatagggccatggccagacttctacattttactgaaaaggagatccatgaagagagaaaggaactttgtaattaaggtattgtcatactgcatgtatcacacaatgttcaagaactttcatcaagggcatgatgagaaaaactggctctggaagatggtttcaggttacaaggaaatctaaaagataccaataaatattttgatacacaaaagtaagataaactaaaagaatctgagaagtcttgagataccggcatacaaaataaatgaacattaatgttaatgatctttcatgttaaattcttatataactttttgtttaataaatgtcatggtcctatataatgtgtttttatgatattacatgatttttacactagaaataatgtatatatggtctttattctccagaaacttgcaaggtctcagagcagattacctgaagctactgaaccttgaatttagtatgttcccacatggctaagaaacatgaggtcaaaatattttttagatggcagattttttttggaaagaaataaactcttttgttttcttgacaacactgtttgatgaatagctttaccctcccctagattctgtgcttgaggagtgtttctattccaacttaaaaacaaagcattaaaagttgatgctaccaatagattactcatctaatctctgatttaccgaaaataaatagtaaacatatttttgcttcactacatactaaatagggtgccatcgaattatacatcattaaaagttttaaaagatcacatcttcccttaccccaatccatctccgcaatttggttaattctttttctgtcctttcaaaaataaatataaaacaaacaaaataacttaactttcagcataaatcctgtgttttcccgaatgtgcttagtaggaaaaaaaaagtatactaccatatgtttgtaattgtagggagaaggaaccataaaaggttacttgttttcatataccttttattggttcactttgctttaaacctttctttgttttgctctattattttttcttccagcttcactgatgtataactgataagtaaaaactgtacatattcaaggtgtatattatgatttaatatatatatattatgtaatgattatgacactttaattaatacatccatcatcacatatggttactattagcagcttttaagtgtcaccctattatttctgttcctaattcttaagcgtcgttttggtggaaactcctagtggtaggaggaagaaataaaagcatttacatccctttaggttgtgtggcctttctttgcctaaataagcatatcattttctgagttagcaatatggtatcagttatatgttttgaagcaataatcatcaaaagtatgacattttatgcaacactgttgatacatataatcttctgctatcattcatctttttgctctaacataggtagggaaagtctaaaggcacaggttgtgagagaaagtggcttcaaaagatctcatagggtacagttcattaccttgtttaattacccacattccagagccagtctttcacctttacaaacttagattctggtttcatcagtactcttggagtggacatctcccagatgtagatataaaatgtattcatttattgcctttagaaaaaaatccaaactcacagatctgcaaggttctagtcagtctgatctttccctagctattcggcttcatcttatgctggtgtcctttaggtactcaaatcctaacctgttctgaccatttggatttctctgcttgaaaaactgttttcccctcacttgctaaacaaaagttccaagcctttcatatctagctcaaatgtcacctcccgaccacccacactaaactgccccttccctcttccactagttctctgcatcttatcactatgttcatttcctccactgtgtttttcccaatgtgagtgcatcttgtctgtctcactactctagaatacaggctttttgaggacaagcaacatgtctgtctgttctttgacgtatgtatccccagagtacataataaagctagctccaaaggtgagcactttataaatatgtcatgtgagaaagaattaactcagttaataattggtataccaacacagttggcataacagaaactgtcaattatttacaagaaaattcattcccttaattttcatagatggcatactctatacattatctgcctgcaggcagaacttctttaaaagcccaatgataaaaagaaaattgtttttgagcctggaattagaacaagaggccttagattgacataagaattaatgggaacaatcagaatatactgatacatccaggaacctaaaagtcaaagactgataactaaatactttctttagaggtaatgcttgattgctcactggcaatcttctatgatgtcccttctttccttgtttgaattactgaccaactgccctacagcttactactttcatgccctaagtaagttaatacattcagtcaagttagtgaaatagtcattctgggttaattaggatcatgtttccaccttccagtgtgtgtatgtgcctgtgcctgtgcaagtacacacactgagtgacagaagccatgaactaaagtttgactatcaggccgggtgcagtggctcacacctgtaatcccagcattttgagaggccaaggcagacggatcacttgaagtcaggagttcgagactagcctggccaacatggtgaaaccccatctcttaaaaaagaaaaacaaatagccaggcgtggaggtgggtgcctatataatagccgggcatggcggtggggcgtggcgggaggctgaggtgggagaattgcttgaaccttggaggcggaggttgcagtgagctgagattgtactactgtactacagcctgggtgacagagtaagactccatctcaaaaaaatcaaataaaattaaataagtaaagtttgactatcagagtttgatcttctctccaagttcttgtggaatgattccattcaagctgccaggtactaagaatatataaatgtctaaatttattcttacattgtacaattcattgtgagtattatctaatacttttttctaaaaatcacattaagtttggccatagagaaatactggttatgaagagcatgtaatcattgcatgcctacatggtgtaggaaaatacaggcacacactgatattttacatgtatagtgtatacagcaaagagagaaaaaagaatggtaatacagaattatgagaattgtttttaaagtatatttgaatctttactaatgactttattgtcttatttagaaaatatgtgacttacaaattaaagcttaaggacgaagacccttaatggaaccattcattagaagatgctatcatattctgacaaaaggaaagcatgaataactaaaataatacgaatctctaaggcatttaaaatatgaagcaaaaaaattttaggtaagatacatttcacaaaagaatttttgacttattaatacttggtactttctgtgaatatactattgtcactggaaataatatatactatagtgagtttcaaaaatgtaactacttcacctaaactatgtgctgagatttcattagagatggtatcaatggtgaggatggcaggaacaaaactaacctgaattattacaatttggaagtggtttgttttgctcccagtactatccaggttttgctacactggcttcattttttgtatttgtgtcaagttttaacatttttcatcataaagaaaaataaagtttctgtgagtttcagtcaagaaaatagttcattttcctctccttttatgagactcagtgtggtagcttacataaggcatttcagctgagcaaaccagctctagtcagctcttctcctcaaagggactggcacagaatacaagacaggattttggccccaagcccacagcagtctatatttttaccactaatcatatacattacccctgtcttgacactgaaaacacacattctgtgccaatcatctattttcagggaaaaatgcatacgcatcttgggataatttccatttacaactggcaattcaatccactgaatcaaattgtactcgttttgattcaaagccaatgtggtaatgcctaaagtgtgaattacaggcactggttgcaacaatgagatcacaataaagaaatacaggagttaatgagagtaagaattctatactccaacactatgtaaaccataaaacattgtcaaaatggaataatcataaacatctctcctccttttgtggtgttataatatcctctctttcatgacattaagttggtgagatataacaattgttagcaatctggactggttctcacatttaaaaaaatactggtgtaagaaatttgaaaatctaggagctctgataaaagcttggctgtaaagtgaaagagagaagaaacatattagctaaaaaagactacaggttttaatcatatttattttgtttgtagatttatcttataaagatggaggagattagagaattaataaatgcataaactttgaggcaggagtcagtaacgtggaagagaatagaaataaaatagaagcagtgattgctggtggagggagaccccagtgttggaagagatgggaggcaaatgcttctgaaagcaggtaaagccatttgcttctacagaagaaaggacactttttctgggactggagggaaaagagctacaggtggatacagataaaatttgaagatacaggagttcaaagaggaaggaatgaatccagcactccactcttacgcctaaagtaaatcaaatactatccattctaaacagtatgtgctcacaatgccttttattccttcccatttcctttataaattacagttctctttttcacctactcctttctcctcagacagaaggcagcaaaaaaaaaaaaaagagctttagtgacctcagccaaataaatagttccttggccagtctgaaaacatgtaaggccgtctagttcaatggaaaaaaactgtacacattgttgtccttaaaaagagcttcaattcttgagtattcctggcaggtccatcatctgagccctccagccttacataaactttattgagtcagacggtatatagaactaaagctcccagttcataaccactagtactctgacaaaccaagaatttcctagcttaaaaccttgagcatcactctaaacagttgtgcatggcaagatgaaatacatcaccaagaaagctcttttcaaagtatttaaatattaatcatgcctctgtcttcaaaagacgatgttctccctttttggtcaataatcacttatctgaccaaccaaaagaatacataagccaatacttttgaaaatgtgttttctgcttattagaagaaggttaaaatttctttctttctttcttacttttcttttttttttttttttttttttgagacagtttcgctccgttgcacaggctggagtgaagtggcacaatggcccagtctcagctccctgcaacctccgcctcccaggttcaagtgatttctcttgcctcagcctccacagtagctggggttacaggtgcacgccaccatgcctgactaatttttgtatttttagtaaagacaaagtttcgccatgttggccaggctggtcttgaaatcctgacctcaagtgatccaccaaatggcctcccaaagtgctggaattacaggcgtgagccaccacacgtggacagaaagttgtaatttcttaaaaaataaagtcttacatctgattcctgaataaacaatgagatagatagatagatgataaaagacagatgagagataaatagacagacagacagacagacagatatataggcaggccttttatggattgtcagcttgtatccaagaaagaaccattatgtatggtctcaacccaaattgtttagcttgtaatagggttaaaatgtaaaatttagtttttaaattttattttaaattataaatattttagtgtccttctgtatataagtatacctcattcgtgtcacatttgttatttggaatactaatgagcagtctaaagctttcatgtgaatctctctgaaatatttctatggtaacacatttgagttattagggctataagcctgaatttgaatgtgatattaactatatactactttcaggcctaaatactacagagtgatgaaagaaagcagaaagacataattataaacatccaggaacacaaatattggaaggataaagctctgcaaaattaggcttggcttgggtcacatgctcatgctgacataggtggggagacaggaacaggggcccttcactgcataaactgcagtggttaagagctcagactagagccctattggttaggtttggtttgactactgactaacacttattagttattttataaccttgaacaagttacttaacctctgttttgtttttgaggatctttgtctctaaaattgatataattatagtaggtatgttgtagggttgatataagaattacgtgaattaaaacacttagggctggacacggtggctcatgcctataatcccaacactttgggaggctgaggcgagtaaaccacctgaggtcaggagttcgagaccagcctggccaacatggtgaagtccatctctactaaaaatacacaaattagctttgcatggtggtgggcgcctgtaatcccagcttcttgggaggctgaggcaggagaattgtttgaacccaggaggcagaggtttcactgagccaagatcatagcattgcactccaggctgggtaacaagagtgaaactccttctcaaataaataaataaataaaacaaaacaaaacacttagaacaatgcctggcacttagcgagtgtcatgtatagttattattaacaatatgatcatcaacaccgttattgataatctcactaggatcatatgtaatacaagtactttttccataagaggtgaaaagaaataccaagtaggcaaaaacaagttgtttactatagggaactaaagatttccttgaggagtaatgctataaccaggtcataatgagcatgtaattcaagcaagactcaattacacatggttaaccctaagcaaacttttgaaatatgactttaaagacatcagcctctctagtatcaaatgactatatggtaaaatttcagtaagagttttacatatggcgtcccatcctttatacaaatcatgtgagtagaagttatttccactagtctacagctgaagaaatggccttagaaaggttacataacttgcccaaggttgctcagtttaatagaaacagattttgtcttaagggcttcaacagcaaagcctgtttttaacaatgacatcaaaaatatctcaaggggaatattagttccaaaaggcattataatgaactagactcaacaaacttaaatggttttctaaatgtaggattttgccatatcttttatatatccaacggtttaatgactctatgaggagatatatatataaaataaaatatgtccaaaatacattggaccaccttttttttttttcttcttgagactgagtctcactctattgcccagggtggagtgcagtagcgcagtctcggcttactgcaagctccgcctcctgggttcaagtgattctcatgcctcagcctcccaagtagctaggattacaggtgcccaccagcacgcccggctaaattttgtatttttagtagagacagggttttaccatgttggccaggctggtcttgaactcccgacctcaagtgatctgcccgcctcggcctcccacagtgctgggattataggcatgggccgccgcacccggcctggaccactttttatagtgtctcccagaacctggatgctatagaagacactttggcaaaccctgcattgtgttatagcctttcctctcctaagtagcacgttcacatgactgtaagatcttatctccaaacttcccatcctactcttttttgctcagaggtgaatctaacatgtagccctttgccatggtatttccattttagtaagctttccttagtaaagtctgctttcaggtaccattcaatgagataagtattaacgagaaggcgtgttgtctttttaaggattcctaataccacatcataaaggcagtcacttcacctagatataagggtagtattctacttatgcatttctaatctaggataagcaatcgtatcgcaaagattataaccaacatatagggtgaaatggaaatctgaaatggataaaaaattttcattctaagtgaaaaaatttggaattttttttttcagtgttggtaaagcctggtatcctactgctactttactttcaattactttggcattccgtgttaaaatgggttcatctttctttcctgaatgacttctttggatgtaacactaagttcaaatgttaatgtgggagctgacaagcctgtcctttctcctgaagactacaaagcatgtgatgtttccatactgacaaataccaggaattagtgaatgttaactattgttgttgttgctattattttttattattattttatcatgtaaggctcactgacttatatgcaacctctggaagtttcatataaaaaataaaacacaaggctgggtgtggtggctcacgcctgtaatcccagcactttgggaggccgaggcgggcagatcacgaggtcaggagatcgagaccatcctggctaacacggtgaaaccccgtctctactaaaaatacaacaaattagccaggcgtggtggcaggcacctgtagtcccagctactcgggaggctgaggcaggagaatggcgtgaacccaggacgtggagcttgcggtgagccgagatggtgccactgcactccagcctgggcaacagagtgagactctgtctcaaaaatcaatccatccatccatccatcaatcaaacactaaaagaaaaacagatatgttatccttttacatatgtatagcaccatgctgagaaaagtgctttggtcactggctccagataaacagagaaagctttagcctacacttgaaaaattaaacatgaatggtgttatttctagagcattgccgccaactaaaaaaaaattcacttttgtatttttccttttaaaaaaatacatgagattgacccagtcaggactcagaaaatgataccccaaagtatgatgccttggcatgctgagtattttgaactaatggaaattgggaaggtctcagtaccatgtttttctgaccttcacccatcctcctgtctcctactcatatttctctcatgaaacaagccataaaaaccagaattcctcttccccaaggcagttattgaagctaaaatttttctctcccagagcaatcatgaaacctgtaagagtcacactctctccttcctcccttctccctttgaacaccttcattcaaaaggggtcctgctccatacccaggagtaaggaatgctacacaaacaggccaaggagaatctgagcaaatgggccttgctgagttcccaccttggtctctcaccattagatcatgcctttttgtccaatcgtatttcttcatggctgtcccattcttcattgaacctaagcataaaaatagacaagtttcctgggtctttgaggcttcatttatgaaggctcctatgtcacataacaccacttttttttttttttttttttgagacagagtctggctctgtcacccaggctggatggggtacagtggtgtaatctcagctcactgcaacctctgcctctcaggttcaagcagttctccagcctcagcctcccaagtagctgggattacaggtgcgcaccaccaagcctggctgatttttttgtatttttagtagagatggggtttcaccataatggcccggctggtctcgaactcctgacctcaagtgatctgcctgcctcagcatcccaaagagctgggattacaggaatgagccaccacacctggctaaaacctttattgaataaatttgttatgcttttctcttattaacctgtcttgttgtagaagtgtgggctataaccctggtgatgagtgaggaaagatatgacatacctctgcccctataaccctatccacagaactaactctgaaattataaatgaatgactttttaaaaaatgaaataaaagtgattattccaacagactagtaacatattccacttagagataacttaaaagagacattaaaatgaaaataaaggtatagatatacttttgttttgtttcgttttgttttggtaccatctgaattattatccatcattattggccatttttcatggtgaggaagaaaaaggcagcaaaagcaaaggtatgtttgattttcctctaaatgatatgaataaaatctacatgggtatggcaaacaaattagagagaagattaccccaatctctgcaaaatgaaacatgctacaatatgttttttcctccaagactgagataaggctataaataaacacataatatgggttttttttttcctctgaaaatttggaaaatattctagtttaacatgattatgtaggccgtcaccgtttttaaaaattgcattaagcccataaactcattctaaattggcagatctttaaaaaggatgtttatgtttacagattctaatgcttttgagaaaacagacacccatttccatttcctttgcttctcaacacatcatgctggtgacagatgtttctgaactgtttcaatgtccctgtctaaatagaaaatgcacacttaatgatacccatgtgtgtatatttctatttctagtcttatctttatatatctacaaaagattgttccccttggtaattatagtcctattcaatattaatgaattattggcagaaagtcactttttatgtatatatctacacacaaaagatctgtttttgtacattatgatgactatagatactcacttatgtttgcttgtaaatgtaaatggtcacaatgttttatatatttttcttttaaaagcttaaacttcatatgcttattttcaaggcatatagtgaaggtattgtttattgtgagagagtaaaagaaaagcagcttagtgtcagctctgctgtctctgactaatctgcaagccacccactttaatggctcttcataaataattcaaattttaattatgctgccagcctctgacctgaagagaaatgaagaaagaaaaggaaaagaatgggccagggaaagcatatcagttgaatcaaattgtgcctacagtaaatgactttgtgtctcacagctgcactttcctactcaagatgcacctgcttcctcatttgcgatttttaaaaataatattagtgtcatctaggatacaccatttatgattatttactttctctatatctatcatatttacaaatacacacttacagatgaaaatatatacctagattataatagagtcccctaatcagatatctccccattgtttcccatttcagactctgttctgtctcctaaaaagtcactggggttcatcataatatcaggcatgttcatatcactgcaatgacacatcaggtttctgttatattaaaaaagaacacataagtcttcgtccaaacccaggtcttgtaagttattgttggaggaactgctgccaaatgaatggctggctgaatagatttaggaaaatcgaactgcatctgtcacacagaaagctggccaaggtagatctgacaggcgatacatggctgaatgatctcttcccacctaaaaacatcttttaattgcatcaggtctctcaatccacagttgagcatctgctcattagaaccaaagcactatttctcagattgaaatgctgaatctcactgtataattttcttctaaatattaccttacaattttcctaaagcaagcaaacccagtcatatttgatgtaagatctctggggccaaatctaatctatgcatattaacaatttttcctttctttttttttttttttttttttggtgtcagtataatttttgtccttctatttatttaacaaagaacacatttggatttcattcaagaaatccccacatcccatttacaataggtccttttggtttatttggaggactcacagatatatttccagaagttgatttaatctgctctgagttcctttttatttctgaataactaccttttacagcaaacccctgtgaaagatttggaaaatctatcggactttatacagaagtattatttagctgtctcgaagatgaattcatcttaaaattatatcattcttcaaccacttgccattatttgcagcccattttctgtttgcctataccctaaaattttgacttttcaatcattgccctctttattttcctccccccttatccagggtttaatttggagaactgagaggcaataaagaatctcttagaatctatatttttggtaacttattttattggtctaatctcaataaagaacctatatttttggcaacttattgctccaactccgtctgtatgatgataaaacagttagatggaaacacattctagctcattaaactgtctatttgatctacaagatggcaaatttatttgtgtatatgcatctttataatgtaccatttcttataaaattatatcaagacagtcttacaggagccattcagttaccttgaaaaaagccacaaaagcatttttattcaataaaccaatttggaagatgaaagagaaactgtctggcttttagacaataattaggtgtgtcttctttgtctatgtgaaatctaggttttgatttaagattgacaagtgcagggtgctatttgttatcaagtggacaggctactttgtaggtcactgctgttctaatctatttatgtttcaaccaattaagataagaatatgcttctctaagtactagtgagttagtttagcagaaaatttcatgaaaatggttgtaaatttacatgtagaaatatagcagtatggaaatcaactcataagaagtattttatgaaaccctaaatgcagtaggtcagtgcttcctaacagaagtctactggcaagaaaggttttcaactctttttttttgagatggatttttgctcttgtcactcaggctggagtgcaatggtgtgatctcggctcactgcaacctccgcctcccggtttcaagctattctcctgcctcagcctcccgagtaggcaggattacaggtacctatcaccacgcctggctagtttttgtatttttagcagagatgaggtttcacaattttggccaggctggtcttgaactcctgacctcaggtgatccgcccacctctgcctctcaaagtgctgggattacaggggtgagccactgcacccagcctcaactaattcttaacaaaaatgtgtttgaccttttcctatgtccagctaaattgtaagaagaactgtactaccttaaagaaagccgaatctaaaaagtatttgatttgcttgtcatatccatttcaatcacaggacaaactacttctgaaaaatttttatccatcaaaaaatctattggactctatgcaaaagtctcaaagattaatctatcttaaaattatatcattcttcaagcacttgcctagaagttttcaatgaatgtgtacagaatatagccttcttaaaactggcaaatcaatttagattcaaatagattcaagacaaatatcacaatcctaaaatgactctttataaaaatagcatttatttttcagtgaaaaatacatttgtgaaaaaggctatactatggttttgatttaaaggataagcactttttatatgtgcatttgtgtgagtgtgcgtgtataaaatccctttacttacattttgcccatttttcttcagattgctaatcttttgcttattgatctgtaggtctgactttctgatataaatacaaccttacagttcataagtgtcacaattagttatgccccagaaccaaatgaaaagaaattcaaatcaggaaaacagctcagaataatttgtttgctaacgattcatctgaagactttcaattatagtacctaattgtataatatggtattactgtataccattattgagtactcatctatttctcccattagcctggaagttctaatagggttctaaatagaatccttctttttataactgtcacctcatacttttcctcatttacaacagcaaacatgattatcttactgaattgaagaaacgaaagcttttgaaagcccttaaacctacaaactcggctgggtgtggtggttcactcctgtaatcccagcactttgggaggccgaggtgggcggatcacgaggtcaggagatcaagaccatcctggctaacacggtgaaaccccgtctctactaaaaatacaaaaagaaattagccgggcgtggtggcgggtgcctgtagtctcagctactcgggagcctgaggcaggagaatggtgtgaacccaggaggcacagcttgcagtgagccaagatcgcaccattgcactccagcctgagtgacagagtgagactccatctcaaaaacaaaacaaaacaaaaaaacctacagactctacaagctgcctatttagggaacaaaaataaataaagaattaacaattattttgctacttttggtaaattaagttacttaaatattttacataggcagaagaaaaatctacgtttggcataaagttgtttttatccttttacacaaaagtatttgcgaaatattaagtggagtttagaaagattaaaattgttcaaagaacacagtgcaataattgcatcaaagttaaaatttgtcttttttaaaggaagtttcacggtaaatgtctaagataatgtttcaatattaaatactcagcaaatacttaactgagcataatatatcacagatatgatataacctttaaaggttctttcacaaaaataaataaaacagccagcaaaggtattacggagagaacctgaaacatactgtttaacgtttatttaattacaaaaatttactgggggcaaccaagtcactcactctccctctaattacacgcagtccttttttttcttctcttcgcttcttcttattcaaccaaaaccagaaatatcaaaacagaagagttaattattggggatgtgtggaccatggttgggaaaaatgttgagaaattatttgggctatgtggagcaagctgtcttgcataaaaagctatattgggctctagagaaagtgagaatggaaagaatttgagagatacctgagaccaaaaaaaaaaaaaagacacaattaagaatgttgaatagaatacaatgacaagaagcctttccaagacagtaaatccaaaaagcctgctaaatagcataagacaggaaaaagataaggaagcaaagggtggctgggaagctttaatccagagctcccgatgtacaagagaggctggcaacaggaaattgaaaagacagtggttctggccagaacaggagcagatgatgaaatggcatagaaaaattgataggaaatgcaaacagttttaaaaagaaagttgatgcctctcttgtatactctttcttggttatgcaaacctgaaacctagatgtcttcttttctatcaatgctcaccttcagcgacgcaacaagacctacacatagtccctctttcctatatctcccatcgcctctatttgcagaactgtttccctttaagctgtcttcaccatcctgaatttctttaatagtctccttggtagcttcctgcatctgattttgaacccctctgactcatacaccccttacagctgccaatgtaaatttacaaaaataccaatcttattctccttttttcatacattttacagacaagccatagaattcaaatccagatgtgcccactcttaagtgtaaaggactccaagggcagatgctatacaagacccttcattactgtcctctacctacttttccagcctcatgtctcaccattttcttcctgcttcataactttgcattgtgtaccacccgaaattctctagaatattctctttacctaaggagtcagagaatatagatgagtttaaaattgatatgctttatcatctatatgcttccatggtacttgtgcatctacaagaattacttgtttatttgacaattttccccactgcactgtgaggtccttaaggcagacactgtccttcaactctacatcctttgtacccagcttaatgtccaaaacataagaggtacttagtaaacattttctgagtgaatgattgaggcatcagcaacaccaggaagaaagtggcagacaagaattaaccccttcatttacattctctcttcttccaatgtcacagcaattttttcaagctccaattcacttttcttattattagagtgcttcagtagatgaacaatgttaccaacagtcaacacaaactttactgacatattcacaaaaaaatcatctctaaaatcactccaatgtttttctatgttgtaacagcaagcagcattggaggctgaggcatctaagatacaaagagaatacaagaaagactccaatgccttattttgttatacagttctgcatcattgttctgcccttctggtttccatatcttgaattccagctttataggcccataacttggctttctatctaactaaattcttcagctgttctctcctcagctatctctgacatgcactgttaatctttgtttttgttttttgcttttttagtatttatccaaacatcttcatgctcttgagtcattggctattccccaaacccaaaaggtagctattgtcatgacttctattactataaattagttttggctaatttacttacccctttacttcatatatattgaatcatataacacgtagtcttctccatctgggctctttggctcatcactattgttgtgagatatataattgttgctacgtacagaaatattttgttctttttattgctgtgcagttttctgtgtatgtatacacctcggtttatttatccaatctttcgttaaaggacatttgggttgtttccagttaaggactattgtgaataaaaatgtgtatctgttgggagacatgtattcatttctgttggaaatatcctagaaattgctggattgtagggtaggtactgccaaagaattttccaaagtggtttctgtgaaatggatatccacacatctaatgtatttaagttccagtttctccatatgctagctcctctcttctatccaaattttaattcttgttttttaagttgtggtcattctagtaaatttctacacagactctttcaaagtcgtcattaccaaactcctattaaccacttctttggatttcactcattgtttaacttatttcattatgtcctttgtctaactactcttatgtcccatttcaagctaactgtattttctccataatcatctttcttgaactgtattccttatttaactacaaactacttctttatccaaactcattcctgtgctgcatcagatgacaaatgagtgtcataattcccatgagactctggctctatttcattcttccactctataaatacagtgttttaaccccagattcaggcctctgctctggcttttttcatgtcaattgtcacctaaatgaaagtacatatccactaccatcctctctctcagaagtgtcaatcttctaattccatttgctgttcgacagctacagcaatagagtctaccatcacctcaaattcatcatgtagaaaagaaaagtaccactttctctagaaactagatcccctctagtccaaataccatgatgtacacagtcattcaatctgaagacctgagtcattcatttttactcttatttctcccctacatgcagtaaatgaataaattctcttgattctttatcaaattttatttcctttatcatctaaatatatagttatttcattaaaatagaacatttttaattataattgtattcattttctaccatccacaaatgaacccattatcacttgtcaaatttcacacatgcttgctaatttctaatttattgattgtggttctcagactatcatcaataccaccaccattaacaaagcatatcatcatgccatatttttgaataaatatattctcccttttgtgtgtgaaaaatagtacgttgttttattatttctatttggaagttgagaaaaaataagctttagatgcacagttattaattagagccaaggagataaacaggcatcaagagtaaggtaaatggctagaccagcaaagcagctaattacaatggaaaactctaataatcattttcctctttcctgaatcgatttcaactttttcaaaataaataatatttataatcatagacaatagatgatggataaatggctagaccaggaaagcagctaattacaatggaaaactctaataatcactttcttcttcctgaatctatttcaactttttcaaaataaacaatatttataatcctagacagtagataatggactagcaatctaaacattactaaaaaaaaggaaaaataaatttacagaagtcaaagctcaattaagcagaaacccaaaatgagtaatttatgagagaaaacttctgacagatttttttctctcaatataatctctaaaagacagatattctataaaacataaatagaatctaaattgtagtattccagcttttagaaaggaagaattctgacagcaagagtattggaatatatgacaaaaatataaaatagcctttattgaggaacttttgtactataggtagtccagtggcggcatcagtcatccaatagtaataatagttgtagtcatgtgttcaacaccctctaatatgccagtgagaagctggaaaaaattactgtagtggcttaaacatatgtctacaaatttgatacatcttccttcaagtggtcggctggatacagcaactcacttctcacaaatagcataaagtagaaaggatagcacgcaacgtaagaaactaggttgtaaaaggtaatgtgaatccctccttgtactttcttgaattgctcactgttggggaagttagctaccatggttaggtgttgtggaaagaagcccaagtggcaaggaactgaggtctcctgccaatagccatgtatacaaaccaccttagaagtggatcttctgaaaacaaaagaataaaggtactactaagaaaattcaaaaatcagcgtaatatcctagtacttcttttggtaaacttatttctgaatgtttccgtttgttgctattataaataacattgttttcttcatttcaaaaaaaatgtgcacagtgaaaatttaaaaagtagatcttgcagcaccaggtaagccatcagagaagcaccacctaagaaagcctgagaaagactcattcaggtaagccactcctaatttcctgacccatggaaactatgagatcagaaatatttgttattttaagccactttattttgaggtaattcattatatgtagcaataaggaaacgtaccaataaagaactaatactactaactaataaacaactttgatattatgttctaaataaaatcacaaaataaagttaaataaataaaataaaagtgagatgccatttgttatctaccaacttcgttgcctaaaaaataatatccaatattgaagaggagatagaaacacactatcataaactgctaaacaattccagatggataatctggcaagctctattcatagtttttaaataataataatataccttttgatatagctcaactttgagaatttatgctaaggaaataagaaatttgtacatctatttctatataaaaatgtttacaggattgatatttgtggtattaaaaactggagttcttctaaattagtcataggtactggcatatacatacgatgttgccattatgattctattttatatattatttattatgtattattgtatatcttctctataatataatattttctattttattattatttttagaaacaggatcttgctatgttgcctgggctgtagctattcacagatgtgatcatagcacactgaggccttgaactcctggcctcaagtgatcctcctgcttcagctacccaagtagctttgaccacaggagcaccctaccatgcctggattattttatttcatttttatatttgatgaaataggaaaacattctgaatatattaattgcaaatgaagggtataattccaatttaataaaagttgtgtgcgtatgcatgcataagtgtgcagatgtatttgcgcctgcatacaggtgcacgtgattatgtaagaatagaaagaagaatgaaaataaaagcttctcgatgttaataatatttatacctgggtgtagaattaagaatatgcttcattttctactttgcacttacccatattatcagtttcttaacaatgagaatgtaatttttctactgaagaaaataatcccagtcattgtaacacactgtgactgctgttctagaagaccatatgtcatttgacccctggctacccctctgaactctccttatatactctcgcacttgctcattaagctccaaccacagtgaccctcctgatcttggaactcaaacagctccctctgtcacagagcctgcgcactaacccctccttttcctagaatggcattttcacatcttctcatggctcctctcacgactgtatcttcctctccagtcactgagagtatcttttgaccaccaaattcaaagcagcctgccttggcaatacattaaaaactatgtttcccagatttccaatcttctcagtacttttatactataaaaagtctattattttctttattgcatatttactttaatttgtaaacataaaattaccatctggaaacttgcctgtcttggttactactgtatccctagttcctagaaatagcaaaaattcatgaaacgttttcttaataagtgagtcctagagtgaatgcttcatttaagttgctgaccatcacatattctttacactgtcttcactcttgggttatagacaccgcacactctaatttttcttcctacatttctaatcagtactgctttctcgttcactgagtcaatcactgttagattattcttatttaagtgcaaaaaggggaaagcaatgtggggagcaccatatctatattgaataatgtacaggggctcatatgaatacaatacacttccacactcaaaagaacactagattacaaactctatgaggggaggcaattcttttttgttggttctagctcctaaatcagtgcctgacatacattaagcacccaatagataaatatgtgttcaatacaggtatttatgaatgaatgaatgaatgaatgaatgaatgaataatggccaatatattttgttccatgcatcataaaaatgacataacttaaaggaataaaataaaacaagccaaattttattatctgcaaggtcacacagtatgacctaaagcatgtagcaacaaaagtatactgagtgaaaattatttgctcatgaaccaatctcatatgcaagcactaagcaaatttgatatgaaatatatagactgctttacaatgcacagctttttccatcaagcagccagctatccggtgatgccaattaaatcacagcataaatttatcacttaaatttattagtgataaaagatcaaaatttacttagaacctacagcaagatccttgcctctgtcatgtagttccctaaaaaagaactggaaacaataccacatttgaactgttctctcaagtaatcagaatttcaataccactcccctgtttataactcctttttaaaattcagatccatctcagagcatgtgcccagcagtgtttgcccattatttaacactttctttttaacttctctgatcttcttgaatagataccacagctgttcacccaaggtgaatgtgaaaccccctatcagattgctcgctgattctatcagtcccaaaagcagatctatcattatctctggaaggggtctttctgcagagagcccagagtttgtgtatgcttttagtatactctccagcatgacaaacaccatctatctggctttacactgtcatttccactgaaaacctgtaattactttccacaagcaacacttcatcctgccaagctgattaaaggcaatacgcacaggaaggcaaagagtagcagcgctcagatatcaaaacatttatcttataagcaacactgcaacggcatgcacacagtaagcactaaataattgtttttagatattacatttgctctttgacagacaatatagttaatgattttctcatgaaacataatagtctcttaaagagtgaatagggcagatcaaaatggacttctgaactgccgtttatttaaaatattccaccataacggacatatcattccagggtcttcactctcaccatctagtttacatctacaccaaataagttaattacttaactattatcatttcttgacaggcaaaccggtaggcaggtacttttcctatcatattctttaactgagttgaatctacttactttggctgattagagccatcaggtttctgcagaagagtgtttggagacagcatcaagaagtatttaattgcaattagataaactttatagtggacacttgtcacagttttatttatttgttgttgtacattaaaacatctttctatatttggggaatttcccaagatataaactatgttgaaagtcaatgttcacatccaagtagagaaatcaaaagcttgttttccctacttccttcgcacctgggacttggccaaacagtttcatttagccaatcagatggacctgccttggatttttaatcctaaactaatgacgtagagaagcaaggatagtgacagacccaccctggccgtggcagcaacatcagggcagcaatagccagtttgttttaggggcagaaatagtagctccaggtagcaatgtaaactatgtttctgttcagggatggtggcaagagtgtcctccccagtctggctcttaatgtgattttaagtttagttcttaattctgtgaattagccaatatattctttcaataaatatgtctgccatttaagtcagcttgtcactctattatttgaaaccacaaacacttactgggacagctttccagtagtgggtactttgatggatacattgacatccatctctccctttttctttttctttttcttttttttttttttagacagagtctcattctgtcgccaggctttagtgcagtggtgcaatctcggctcactgcaacctctgcctcctgtgttcaagcgattctcctgcctcagcctcccaagtagcttggactacaggcaaccaccaccataaccagctaatttttgtatttttagtagagatagggttcaccatgttggccaggatggtctcgatctcttgaccttatgatctgcctgcctcagcctcccaaagtgctgggaatacaggtgggagccaccctgcccagcctccatttctctttttttaacatcactttatgtttggccatttagagatcgttcaaaacgctagcagctaaaacacaatggttttgttggacagacttttcacatttatctgtgtagcagtgtcagtctaactcttatttgaatatttaattgcgttttgccttttcttttggagggggatgaagtctcgctgtgtcgcccaggctgtagtgcagtggcacaatctcggctcattgcaacctccacctcccaaattcaagtgattttcctgcctcagcccccgagtagctgggactacaggtgcccaccaccacgcccagataatttttgaattttcagtagagatggggtttcaccatattgaccagactggtctcgaactcctgaccttgtgatctgcccacctcagtctcccaaagcattgggattacaggcatgagccactgcgcccaaccccctttttttatattatacaacaatggctatagactggaaaagtaaaattgctggtacttggaataaaaccatgaatgtgattgccttagtagggttgtgacaatgatagacctaaaagaaaccagtctatcttcaacctcaaccggttgtgtgaggatacacacacacatacacaaaaatatgttgagaacatataattgaagattgtcataaaaaaatgcatatttgattttttaattttttacttttatttttttttttttgagatggagtctcgccctgtcgctcaggctggagtgcagtggtgtgatctcggctcacagcaacctccacctcctgggttcaagcaattctcctgccttagcctcccaagtagctgggaccacaggcacatgccaccacaccgggctaatttttgtatttttagtacagagagggtttcaccatgttagccaggttggtcctcgaactcctgacctcaagtgatccagccaccttagcctcccaaagtgctaggagtacaggtgtgagtcaccacacccagcctataactgaatttttaaaaaataatttttagctctctgacaacaaggctcctctctcctttaacatgtatgttaaccttcatttattcaacttttggtatgattcccatataaaaataggagattgtctgtatctatcaacttcttatgttaatacaatttattcaaaagatggaaggcaatttatttatttgaaacatcactgattacctaatatacttatatcaacaaacaaaattacacatcttcctggctgggcgcagtggctcatgcctgtaatcccagcactttgggaggccaaggcaggcagatcacctgaggtcgggagttggagaccagcctggccaacatggcaaaaccccataactaataaaaatacaaaaattagctggatctcagctactcaggaggctgaggcaggagaatcgcttgagcccaggaggcagaggttgcagtcagccaagatcataccactgcactccagcctgagagacagagtgagactctgtcttaaaaaaaaaaaaaaaaaaaaaaaattacatatcttcctgacaaaaagaaacttccaatcttgagtggagatgataagttccaaaaatggttaccaagtctgttataaaactcatgaacccttttatttctttggagtaagaaatacaacaattcaaacagaaattaataataacctacaagattgtaattgaatccccacatttttagttctattagttttattcgaatagaggatccaaaatttaaattaaaccttaatggcatcaaagcagatacagaggggtaagacttaaaatgcaagcacatgtaagggtctactcgttcagcacagacactcctgttgaaatgtcaacagaacacatgaattggttctcagtaatttcaaaggcttctaggaacctaagcaaaaccatgtgacttctctttcagcttctggctcccttaaagcttccaaccttccctcagccacccatcccagcatttcatccaaggaagctatgcagaaaagtcagtgccaaggttttctcttccataaaaatttcactgtattttgcaggccaactacatggtcagtatttggagaaagaatagaattttcttgttaaggtaattccattatgactaataggttcagaggggcaataaactgaaatgaatatgttctgcaaaagtatgtggatagagggttctttctgcccctcctctatttcaggctgcaatgcatccatttccattaataactggaatttatttatttatgtatgtatttatttatttatctgaagttattacaagtggtatagcccacttctgaacagttggcaattcaaattttagggaaagacacatactgcaaattaagaggccatctatagaatctgattatcaaccagtctgtagttgttataatccaaaatgactggctaataatgttttctctagggcatttcttcatcatcgactattaatacttctaaatctcagtgacaaagacctcttccccaagtttatattcatctcaatgaagataaatctgtataggactaaaactaaacagattccttaaataatatccagtctcttcttctaacctaacttttcataattgctctctccttagactgcagggttcccataacctactgctcctttaatagttccttttaataactgatctgttgttaagatttgaaaaaattaggtctccctgaataaaatcataataagtatatataccgcttattatttgtactctgtagctttagagttatttttttaacctaaaatgtaattagattgtgtcttaccacaagactaaacttggtccaggtaattttcacacaatctggtctctctgttcacagcttaagtgatcaaaactaattggacctaaatatctgtaacaatacaaaaatgatataattgcatgctattttctatgtcttctcttttaagtgacaagaaaaaaaggcacagtgattacacaaacaaaacactttttaaaaacctggtattgatttatttaaagtaaatcttgtgaatcaaaaagaaggactaaaaatatattaattttcaaatgaacaatgtattttattttgaatcataagtgaaaatacatgttacttgtatgatattttattgttagatttggctagtttccatttcaagacatttaacatataaaaatagtatgtgtgcatgctcatgtacatgtacatatatattacatatgacagagaggaaaatttgagtgacaaaagtactgacaaattataattttcagaattccaggacaaaagagctcataaggacaaaacacgaggctcaagtaattaataaaacagttctgtggcattttttgtttatgctaatatcttcccaaatgacactttgatgtgtgccatcttaatatatcctgaagagcacacaggcctgtcttcctactcccaagctgtagtccagctctggaagaagctaatgatcttcaccattacatgaaatttacattttttaaatttagaaaccaatttaggatcacagattctagaattttagcgttagaagctttttatgtaatctcatctaccccttttacatagaaaccttacttattaattattttaatttaattttattttttagagacagagttttgctttgatgcccaggctggaatgcactggtatgatcatagctcactgcagccttgaactcttgggctccagtgatcctcccacctcagcctcctgtgtagctgggactacagacacgtgcaccagtgcctgcctggaaattatttatttgtctgaggtcaaactgcaagtaaatgaagaaccaagacacaaatttaggctcctgatttggaatccattttagtgtatttccacagcagcaggtatatcatttgggtttcctttagctgcaagtaactgaaaatccaactcaaattggtctgatcattaaggaatttactaaactggagaacaaggaagtccagatgtaaagtgtgattcagtgttagttgactgaccacctccacatcagcatcaactaatcaagtcctccataatttaaaggctcctcttgttctcaggagactctggtttggggccagtggaaaagagagatttttcttcctcacaccactactgaagagacttgagctttgcattgataagactgctcttgaaccagtttttctagacaacagaagaccatgtgttaaccaacggaatcttgggtttttataagaacaagtcattgtgtcgagagacgcagtcccatgtcagtaactggtcagtgtcatccaaaccagatggatgctacacaaaggagaggggtggactcactgttcaagagacagccacaatgtccactacacaagacaatgtggacatataattttttcacccaaattcttaccaactaactgtcattccttagaaagtgaatattctcaattatatggagtttcacatagattaaaaagcaacattatgccaaaaaaattctgtcctctataatatttataaaattcagagttatgccttgcctttcattttatctgcacaaatatttctattaaaaaatagttcaaaacactgtaagcatatagcgggatatgataaagatgctatttttatagaatttgtatcaatgttaaatgtaagaatgaatataaatatcaaatgtacgtgtcattatgaactttcatttaatagctaaaatgatttataaatttaaaatattatatttaaaactctctgattccattctaaaattgacaattccctttataaatgtaatgtcatacatcctgcaataacttaggatgtttttcatgatagcaattttgaaaatctttcataatattgtaaatatcaagaaaacaaagcaaagaaaaaaagaaaaaagaaagaaaaaaactccatgtgccaaagctaaatctaatctgttggccaggcacagtggctcatgcctgtaatcccagcactttgggaggccgaggtgggtggaacacttgaggtcagaagttcaagaccaaccttgtcaacatggtgaaactccttctctactaaaaatacaaaaagttagctggatgtggtgacccccgcctgtagtcccagctacttcggaggctgaggtaggagaatcccttgaacccaggaggcggaggttgcagtaagcagagattgcaccactgcactccagcctgggggacagaaccagattctgtctctaaaatataaaataaaataaaaataaatctaatctgttattgcagttatgttcggatccaccgagtgatctagggaagttggggaatatcggaattgaaaatacccagtatgctcccaacaagttccagggagaaaaatctatgtgaaagttgtaactgatgcatcctgatccatgggttgacccctttgagacaggtaagagctgtgggcaggaaggttagcaggatttgtgagaaaaactcttagcagaaggagggcgtgtctgatttcccagtatacttaacctaagtaattatcctattttcttatatttataactagttcatatactgccaacaaataaaatgatgttttcataattccattttattaaacaaagtgttgtgtaaataaaattgtaaaatgtgggggggggaatcacagagggttatctataaaaatatccaaaacaataaaattgattcctaagtaagaagacatctttgaggatatttctgatttgttttcctttagttcaaatttattttatgtgcgtgtggcagggagggtgtgggaaggggcacctcaggtacaccatgcacattcctacaatacattacaaatttaaacgctgcaattcgcctaatataagaatcaaattaaataaaactggtaatgccatggcaatggtgactatgcattcagaatttttcaaatatttttaactttataatagaaccttcatttaaacatctgaatcgagagacagattttgtttcccacgctccttacaatgtattataagaaatctgctactacaattgtattttgaccatattagaccttccctgaagaataccaatctaactgcggctattaaaaaaaaaaattgaagttaaaaaaatttcatttcagaaaatagtgtacctatcttttccattctgtgttccagaattcaacctgagttttctcaaattgttgttttatgagacatttacaaagctgtcttccacaaagtttccttctaacattagaagaagacaactcaatgcttattatatgcaaggctgggcaggtgaacagtgaaaagataagccaggaaggatccagcatctaaatagcttatgattttatagaactttaaaatttacaaaaaagcatagatatttattcaagtattaaaacatataatcaaatagcataaatgttgatagagttcctaacaagcaatttcatatggagattaaaacattaatggagaattttaagtgaacggtatctgtgaaaatggagagcaagttctaaggacttaggagtaaaaatgatatggtcttggaagaagatgataggaggaagattcttatatactaacaatcaccataaagaatctctattttttttagtaacataaggtcacacatggactttgggacattaaattgcataagggaaaaatagcattaatgcatgtaactagtacaataatgcaaaaactaatgaaacagagctgaacatctagaaacaaattagcagatatataattttttaaataaatgagaacatgattctagaatgatcacttaactatttggaaagaaaaataaaaagatgcccaccttgcagcatgtaagcccattcatatagattaagaggttaaacatgaggggaaataaatcagaaaacaatgaaagcataaattaaaagaaaaggaaacagctcaagttagagatggtctgtttaagcaaaacttcaaatatagaaactacaaagaactgggtgtagtggtgtgcacctgtagtcccagatactagagaggctgaggcaggaagatcacttgaggcaggaggtggaggctctactgtgctatgataaccactgtactccagcctgggcaacataagagccttctccaaaaaaaaaaagaaaaaaaagaaaaaggaaaaaaactataaagaaaaaggtaaatctacacaaatttaaaaataaaagataaaagcaaactgaaataaatatgagcatcacgtatcttgtatctccaagggcgagaccatgcaggttaatgtagaaactggcttagaggtttaactgatacattaaaaaaccactggagtttgcccaggtatttactattttccctcttgttgtgagggttaatacagttgtcttagtccattcaggctgctgtaacaaaataccctagactgagtcatttataaacaaagaaatttatttctcagttctgaaggctggcaagttcaagaccaaggcaccagtacattcagtgtctgatgagggcttgctctctgcttcaaagatggcacctagttactgagtcctcacatggcaggaggagctgaagagcaaggaaggtaaactctctccttcaagcccttctgtacagcgctaatggcatccaggagagcagagccctcatgaccttattacctgtgagaggcctcacctcataataccatcaccttgagggttaagttccaatataggagttgtggagaaacatcaacattcaggccataggaatagtatatatgtggcttgggttgtctttgtaatgtacataagaccctgagaggtccagcccttcagaacttaacaaaactcaaatttttacgcatccattttttttttaaatagccccaacaaacagatttttagccacacaggagactgcctcctttgtgtattccttaaaactccacccacatctactagcaatagatcaaataagcccggggcgatgaaaatcccaaggccctgctgccatgcagagctctttgatccacaaccacccccagtgctgcttaatcactgcacatagacatgtaagcctcctctctgattcccctcttcccaggagctccccttgccctcctcctcttctcgatggtggtcatggccataagcttccagatggcttcatgctgtgagagacttcctcgctcttgcattcctgttcaagggctgcccaataaaacctgttttgtggtaatgcctctcatggtcatatctttcctcaatcaggccccaaatcctttgaaccccctacacagcccaaccctgtgcaatcctgcagtcctagccaaggtacctttcccagactgaaaagtgtcatgatatgcagtacgtactcttgaaatagttattcccttatttacttataacatataagtaactctgaaattcttcagctcttaaatgaagtacgtaactgttataaaaaaagtaaatgctgagcagggggtgataaggaggtgtcagggcagtactatccatatattatggtagctttgggttgcagcacattggctggatccactatgattagtggactatatgtaacattttaaaattgaaccctttgaagagtaaatgtgagtagcatatatgaacgcatgggacaggacttttcctggtaaactggaacatatggttaccctaattattttgacaatgacatatttaaaaacttgatactggaggccatgggaccctctatgaaaaacacaggttatgaagactctttcctacttggtgatgtcttacgttaaagtacgcaacactggcacagctgataaaatacagttgggggtatgcacatgaatgaatcattctattatttgtagatcaatgattaaaaagccacagatggattccagtgaattactcctgaggaactgaaagcattttcttgggctatccaatggcaatatttgttgttctccttttcccttgtctcttcttcctctctgtctctgctctgccacgcccccttgtaatacaccactgtttcgtactttttctcctttttttccttctctcccatatctgcttatttaacatttgtgtgtctgccagtagcttttatagatattacttgctatctaggggctttaatcacctagacagcaacataaagttgttttggaagaaagggtcccaagcgattgagaaacaccctttctctgggaagtctgtttttcctgtcttatcactgtccctgttggtgcttgtcctctgctctcttaccctcatactcgctatttttcttgctgaaaaagaaacagatttataatcactcgcaggaaactctgattctcacatatttactaaaacacacacacaccccaaaactacctactcaaaataattttaaaactcattgaaatggacacaaggtttatccaggcaaaaacagatatacaagtatcttatagctttttataatctaagcaaaatacaaagttgtacaatctttccaaagtgattttctgaagtcctgtttctagcttggttcattgtcctaagtttccctactttcatattctgaggcagacactgattattgacgtagcaaagcctggtgggagaaggcagattagatcatgtctcaatacctcatctggtcttaaaaagctttagtttattctcacacaaaaaaagaaagaaagcaaaaagaaaaatgttttattttcttttttttaatcaccaattggtttttgcttctttagccaagttactttgtccccatgcctatttaagtgtgtggagatttttccccccatttacaaagatgaaatagactccatgggctgcttggaacacatttaacttatctataggtttcaaaagcacagcaggtccagggcatgaaaaaggcaggcaggtgctctttgcatcctgcaccatttaacaagcacgcacagatttaaagagtaatttcttctcttctcaatcatcagctgatctaatttatagttcatttattattaattatcactgtcttcacattctttttaatcatatatgtctccaaccaagggtaatgacaattagcgccaatgtattatttttccttttcctgtagaattccagtaagtaacttcaagtctaattgcacagtccctgacatacaaatatattagcatgtggtaaatctagcttagacttttggcttcttcttttctttctttttttttttaatacactagagtcccttgtttatttccaaaaacaaatttcttagtaacttaaattatatttaggcaggcagttttagcaataaggtcactggcctcaaggatggatgttatccttggctgggatgttctggagaaataaccacattgaattctattatatctcctcccacatgcaccccaatgcacagttgtgtttgttttccattttctttctcatacacaacatctgtcctatatgcttcactgcactgttttttagtgaagaaaatgcagctgagaaaggaaatgaatatcaaattcagagctcccaggagaggtgacccaaattctcaaatgatagcattatgatgcactttctactttcagatctgggataccatagtatgattccttaatgatttaaatgtcatgtactttggcaagctctctctgacaacccttttaaaaatgatgcagacaattaaaataatgagagaacaaattatcagccatctaacaacaaacataaaagtataaagctctgagagttacaagggctaagaatagggcttgtttatctccttacttttttttgtttttttttgagacagagtctcgctctgtcgcccaggctggagtgcagtggtgcgatctgcaagctccgcctcccgggtttacaccattctcctgcctcagcctcccgagtagctggcactacaggagcccaccaccatgcccggctaattttttttttttttttgtatttttagtagagatggggtttcactgtgttagccgggatggactcgatctcctgacctcgtgatctgcccgcctcggcctcccaaagtgctgggattacaggcgtgagccaccgcgcccggccccaagttttttatataaaggtcttcaagtgccatagagtaaactttcctgcaattctcttcttagcatccattccagtattaaaacttgttttgtttttcagtatttcttaaaagatgttattatttgtgactcccttttatcctacccttgtcctctaaaagttatattatgaataattttaataaaattacaggaagagaagattgtttggggcagttaaggtaactgaagggactatagaaggagcactcacattaaaagatgtattattttgcttctatacacacacacacacacacacacacacacacacacacatttgaatgcttagcttcttttaacaaagagttattgaattgatacattctgttgagtcatccaggcagactaaaaattattcctgctaaaatatttgtatctcacaaggcatacttgtctctgaagacactgatttaatattccatatctgtaaggaatctgatgctaattgagcaggttttcttctagtattaattttaattatttagaacagcatgaagctcttcgtaatttcccacctgacaactgggacccaaaagaacagctgcctatggttttatgctcctatgagcatgctggatatcagagtcaataagtttaggcatgaattctctgtgtgttccattgaggttgtgaaaatcaagccttttggaggagttcagaggaaacctgcaactgagaatgatgtccatgccactgtgcaaagtgttatgacagtcatagatctcaaaggagctacaggaagcgaggctccctgctgtaatgaacgcagcccatagttaaataataaatcacagtcatgtatctagtctgcaacagccactacctatcagaaagtcaccatgaccacatagtgcaaatatttagttccacacagttataaatctggatgggatccaaataaagtagttatctatttgtcctttataaaacagaaaatgaatgctatttgtttatggtgaattgaaagtcaaaatatttgaatttatcaaatgcaaaaaagtacaataagacctagtcatatacctccacatttaaatataccccccagcatgactttaagaatcaagtatccaacatatacataatttagtacaaacatcttttgacacctcacatttttttcttttgcaaaagaacaaaaggcttcttgtacaaacacacaccattgtatctgctctcagatatgccaattcgcaatacaatgaacaagatgaattattcatttgacaactgaaattgtttgtggacgtaagtttgcagaggcctagaataaaaaggtaggtaaaaatgggactagaattgaacacagtaaaaaggcattaaccattccaaataatttaaccaactacataattaatttctaacttcaaggtatgataaaggtctttcattaaaaaattaaatatgactctcactgacttaaggcatagagggaaaaaacaccatttaacctaacagagctcaaacacagttcatttatcttgaatctctatcaacaaatacttggctctgaaacctcactcatctttgagaaaactctaatatttacggcctttttaaacgtgactgaaaagggaggaacttgtctttctaatgtttatatccctagtagttggcagagtgcttggcatatgccagtgatcagtaaatattgttgaatgaataaccttatcaatggcaccaggtatagggacatgacatactgtccccaagacaagtattttccactgaaaagactgcctcatcttacccttaacttttttgttgctgttgttcacttaaagtagaacctacattactgttgtgatttctgaagttcaagctgaaggctctttagaacaaattaaagcagagagaggctagaagttgaaatatcatttcagaagttgttcctattaggttggtgcaaaagtaattgcggtttttgccattacttttaatagcaaaaaccacagttatgtttgcaccaacctaatatattccaggtaagagttaatgaagttctgaactaagcgaaaggaagactaaaggacagaggcaagcataatacaggaaaaatcaaaaggatgcctcaaatattttcatgaggaggtaaaggaggaggaggcattaattgttgttattttaattttaggttatggcaaaaatagacaattcgacaaggaaacaggtacatctttcagcagtaatatactaagttgaaataagcacaaacctagacaagacgtaagagtccaagctaatctttgagggtaacacattgttttatataagaaagcaatataaattcatttccaattgcaaacagtttcattttattttttattaaatcatattttccccatataatataggtgttcaatttaaaagtcaatgagtactacaggtcgtatattaaaaaaaaaaaaaaagccatgaatttttttttttgagagggaatttcgctcttgttgccccagctggggtgcaatggcatgatctcggctcaccacaacctctgcctcctaggtttaagcgatgctcatgcctcagcctcccgagcagctgggattacaggcatgcaccaccatgccgggctaattttgtatttttagtagagatggggtttctccatgttggtcaggctggtctcaaactcccgacctcaggtgatccactcacctcggcctcccaaagtgctgggatttcagacgtgagcccccgcacccagtgaaagcattatttttaaaaagcctgccaccttccccactcttaattcacttctagagccagtcattttctactttcttttctttttttttttttcctttgagacagggtctggctctgttgcccaagatggagtacagtggtgcaatcacacctcactgcagcctcaaactcctgggcttaatggatcctcccacctcatcctccaaaccccatcccctactatctgggactacaagtgcaggccacttgtacatataattctatatcgatatagaattataattctatatcgatatagaattctatatctataaaattctatattatatatttaaaatattctatatataatatatatactatatagaatatagtgtatatataattcctttatatatagtatatataatatataaatatacatctatttagatatatagatatctttatacatctatttagatatatagatatctttatacatctatatctatctacatctacactagatatataatatctagatatataatatataaaatatatatttttattatatatattaaatatataatatataaaaatatattatatatatttttatatatagatagatctatatatagatagatctatatatgtgatatatagatatatataaatatatatatttatatttatatatactagatatataatatataaaaaatatatataaaatctatatttttatatctatctgtgtgtgtgtgtgcatatatatatatttttttttcttttttttctttttgtagagacgtggtctcactatgttgcccaggctggtctcaaattcctgggctctggtgatccttctgcctcaacctcccaaagtgctgagattacaggcgtgagccactgcacccagcccagagctaaatgttttcagttatgttagctatttttgttatatacttccatttttaaatataacactctaaaactgctatacatttttaaaatttagataatatccacaaaattgttttatcaaaatacatatttatttttcttttgttactttcccttccccactacaaacacacacatacatacacacatgcacgcacacacacacacacacatttttctcttcctcaatttttccagtttagctagtggcaacttttaggtagttctataattcagtgctgacataattatgataatgaaaatattactcatagctaagcaatgtagtgtgctgtgacacttcctttattttacaacttattgatttccctggagttatacattctcaggttctctaaaggaaaacttagtcacttcaacaggatcaaatatattcagcaatccatctgcctcatgttttccttggagacataagtcctggataactccatcaccctgcacctatttgatgggattaaactccttgcttgctgctctgctgacatcagtaattgccttgcttcttcgtttccaatttcctgtttctttaaaacaatccatgtattccttttactgtttgtttccttgttttgttggagcacttcctccagtagcttcctgagaaaaggtgcatcgggaaaacaattttttgaaaatttacgtgctttaccttacacttgattgataatttggatatacaattctagtttggaaattatcatttctcagaatttttaaggtatttcacattgtctttagcttccagtgttattaaaaagtctactgcctttttgactattattccaatgtactgtcatttatctttctctctggagctgtaatataatttcttcagtgttcccaaacctcttgtcaacgtcctgttcattatttcacttcctacttatgatgtctttcaatctggcttccaagtccattagttatgggaaattatacatgggtatatataatttaaataaacaaattttatatgaatatatgagtaagcattcttactatatacaaatatatgagaatcacaaatacatatgtatgcatatatgtatatgtgagtatatacaaatatatacacacacacacatacacattaaaaaataatttcttccccttgattttttttctttcttttcggaaaccttattttatacttcatagactgatctaatttcctatgactttatcttctattttttatttctttgccttttttctaggagagtctccttaactttacctttcttcacttctacttaatgttgcagttatgaatttttataaattatctcaatggcccttttatatagcactctaaatcttgttttacacatgaaagatctcttatctaaggatgtataatatcattttttgaagttttcttcagtttcctgcattgtctcggttgcctctgttttttgcttttgtcttttttttctttttatcctgtttgtcattttgactttctcattaagttcaaagctttcttcaatcatacataatctttgtttatccatatttaagagtaagactttgaaaagctagttgaaagcccattctgcatgggcaggtttgctaacaggtaagtagggtgttcagttggtgacctggccattttgtttgcaaatcccaaaatgtcagtctctgaagagctcctctcttgtgccaatagctgcagaaattacgtttacaaactcctttctaattctaggattcaagaagggaggagcctgggtatctcacacctcaaagaagaggctttatttaattctaaaatagtttcctgttttagaatgatgcctcatacatctcttagctccagctatctctgagtccagagcttcttgggttcaacccagggctgagttcagtatgggaaggatctgggaatataatttattttaaacactttcaatgaatctttatgttttcagctatattttgcacccagctttttaaaggcagcttgtggctcctgtttctaaaatcttccagagatatgaggtgcaaatgtgattatttcccaatagaaatatttattatatattatcccagtagaggcccttagctttttgctctttctgctcttagaagacaatgatctctcttctggctctacaattttgttagcatttcttatctgacactatcttctcttttatcatctttatcctcacagatttaagtcttcatttttcctttattttattccaatggggcatttgaaagaaaataaagatagatatgcttgttcaagccaccatgcttaatcaaaactctagtaaactgaactattttaacataacataaattgttcggctatattttaatatggctaaatatctagtcaagatattcttatttcttactactaaaagtacttaaaattgacagtaaaaataacttggcctttattacataaaattcaaatatttttggtttgatgtagaagtcagctgtaacatagatgcaggatggaaattttaacttgatattaggctcctttatcacaggtcttctcttgaatctaggaattcggttattcacacttgcaatttctatatggtgacatgactcatcatttatttttactataattaagttttctgctgcaacagaaatatgactttttgtactctgagatgagctattttattctggaaggaaaaataaatttcacaataaaaagcagattgactaatggttaatgataagtcatgtcattaagtatctcccaatgttaaaaatatgtcatgagtcatgaaatctagtaagctaaaataattacagaggaatccctgcaacaaaacagatgataaaccaaatttaaagcagttatatatctgaagcccaaccatgtagaagaaaatttaaaccaacagcctacaaagtaagtatcaatcttatcattctgaaactttgtaaaggaattacactaataaatttgagttaattttttaatttatatttttctagctacattttatgttgttaaaatgttttacttttacatgatatatccaatttataaacatctacatgacaaaaaaagaaagttaaatcagtccaagacatatcaactgcagaaaactaatacagggctcatagttataatttgtcaatattttacttgctaagttaaaaaggagaaagacaaaagacttgccatctaattattaattacacaaaaatctttcaggaaaggaagtgaaacttgagacatcgtttttggagaacacctatatttccaatacttcattttgcccatttcctcaaatattctataaaggaaaaagaaccttaaacataaatgttaatgtaaaaggtttcttgttacagtaaaataacaaagtggggagatattgatcaaaaggtataaaatttcagttagacaggtggaataagttcaagagacacaaggtgagtataattaataacaatttattgtatacttgaaaatgtctaagaaagtagcttgtatttttttttttttgagacagggtctcactctgtcgcccaagctggagtacagtggcgcaatcactgctcattgcagccttgaccccccaggctccagcgatcctcctgcctcagcctccccagtggctgagattacagctgtacaccactatgcactatacctcgctaatttctttctttcttttttttttcttttaagagatggggtttcaccatgttgcctaggctagtctcgaactcctgaactcaagcgatcctcccatctcagcctcccaaagtgttgagattactcagcctcccaaagtgttgagattagtgatttatagtgtataaacataaatgagtcactattgctataacacagggccagtttgtgacaaaaaaaaaagtgtgaggatactgggttaacatgtagattctgatacccaaaggactataaatcatgctgctataaagacacatgaacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacacctcatgttctcactcatagatgggaattgaacaatgagaacacatggacacaggaaggggaacatcacactctggggactgttgcggggtgggggaaggggggagggatagcattaggagatatacctaatgctgaatgacgagttaatgggtgcagcacaccagcatggcacatgtatacatatataactaacctgcacattgtgcacacgtaccctaaaacttaaagtataataataattaaaaaaaaaaacatgtagattctgaagaggaaaaactatttctgtaagtgacccctttaaaatgggattaacatctcagagcatttctgacatccgaatcagttagctcaatgtgtctgctaaaattttgcagccttgggcactatagctgttacaagtaagtgaagctttatgctactgcaattaattagcagaaagacacctaattataaacctcttagaatagcaggaaggattttagagaaatttagacccaagatgcttaattgcacattttatttaaacaagttgtatgtctccttttaaagctatctgttaaactcctattcacttcagtatggactgatttaaaatgcagctatagcattccctgaccccatgccatcccacaacaaaacagagttaatcattctctcctatgtattaccactgtatgtggacattctttatgatttcatttgttatatagtattctgattaattgcatatgtaggtgaatatgaatttttgccactccaacctgtaggagcctagcaaatagttggcattcaataaataagaatctatgagatttaaaattaaaaggatttatgcatgtagttggtgactgcctatgtatctgcaaaaatcattttaaatgtcagggtttaggatactattatttctcattagtaaaaactcatattggcggggagtggtggcttatgcctgtaatctcagcattatgggaggcggaggtgggaagatcgcttaagtccaggagttggagaccagccagggaaacatagtgaggctctgtgtctaccaaaaaaaaaaaaaaaaaaaaaaaaattagccaggtatggtggcacacatctatagccccagctaatcaggtggctgaggcaggtgaatgaatcccttgagcccaggaggctgaggctgcagtgagcaaggtcgtgccactgcactccagcctgagcaacagagaccctgtctcaaaaaataaacaaatagaaaaaactcacattaaaatgtattaccctatttaatagtataacaacaatcttgatcattgatctgtaacatgaatgtctcctggcagctaatactaagataccacacctgttaatacttcctttgtggggggagatgttgaatggcaagctatcacttgttttcagttggtaacttcacataattagaagtgtgtttcttctaatattaccaatgctgttgcacaatagaaagaatgtatacaatttgtagactagcagagtcaacattccttttcaaaaaaaatttttgtaaaaaagtcattgtaattatagaataaaaagggtttctattaaacaaatgaacaaacagaattctaggatacaatggctacgtttttattcctgagatcacctttagcctttttaatgtagttgtagtctttaccaatatctgtgccttataacattggccagcttattctatatagcacattttcttgggaatgtattatatttcagatgctggaggctgttaataaagattttactataaaacaaaacgactaataagcaatcttaataaataattatgtattcatccaccttcataaacaagaaacaaccttaagtttcctcaattattttcttgtaatacggatatataagaagcagaatttattgccaaggggtggttttaattagaatcaagtagagtaaaattgaaattttaataattttttaaaaacctttcctcattaaatatattaaaacaaaattattatgaaatacatcactaactagaaaatgttattcaaaaactcttcaatacaaaaatgtttgcagctattgtagaattatacacaccgactggtaattattgagtaatatttagtatgaatttttaaaatgctccagtagcaaataatgactctaaaaactagtatcatgtaaatgttttccaccaatagggaatcccagggcaatgcagacattcccatctaccacccagttctttgatttctgagtgtactagtatatataaaaggactagaactgtaactgccactaaaagataacattacagagtggcattatgaagtcatctgagattccactgtcttctttcttcttctaagcttatatatttcagaaacataatccaggttttccattcttttctataatattgttaacatctgaatgaccgtatttactctctttacttaaaattggtgaccagaacttatgaataagtttcctttctttactttaaatttcatatttatagttcaatcatactatgaaatttatttttaaaaagagtgcaaatgtcttttttttttttttaagagacaagggtctcactatgttgcccatgctggaaagcaatggcttttcacaggcacacttcagcctctaactcctaggcttgagtgttctgagtagcaggggctataggcgcatgctaccacacccagctccaaatgtctaatgaggcaagtttatgtacatataattcaattaataagtaaaaataggccgggcacagtggctcacgcctataatctcagcactttgggaggccgaggtgggcggatcacctgcggtcaggagttcaagaccagcctggccaatatggtgaaaccccgtctctactaaaagtacacaaattggccgggcgtggtggcgggtgcatgtaatcccagctactcgggagactgaggcaggagaatcctttgaaccggggaggcagaggctgcagtgagctgagatcacgccattgcacccagcctgggtgaaaagagcgagactctgtcaaaaaaaaaaaaaaaaagtaaaaataatagtaaataccaagtcattttttactcacctggttaattgggaaaaaaaaattctctgcttatcatacaaacatgttgttaacattaaagacatactatgtacaaaatgaaagttgatcatataccaaattattctcagtaggtttttttgtttgttttggggggttttagggagaaagtaggttaaagtggaaacttttactttctcattattgttttgggtattttgcaatcagcattttctcagaaagaacagtgaagatagttttacttaaaaagttagatgagaatggctgggtgcggtggctcacgtctgtaatcccagcactttgggaggcaggagtgggcagatcacttgaggtcaggagttcgagaccagcctggccaacatggtgaaaccccatctctactaaaaatacaaaaattagccaggcgtggtggtaggcacctgtagtcccagctactggggaagctgaggcacaagatcacttgaacctgggaggcggaggttacactgagctgagatcatgtcactgcactccagcctaggcaacagagcaagactctatctcaaaaaaaaaaaaaaaagttagatgagagtagaatgcataatttcaaagtgtcttcacttcactatcacatctttcaaacttcagttttattatatgagtagcaatcagataaacataattgatttctacagccctaaattaataggattatagaaaatcagaaaatattagagagcttataaagggaaaaaacctatattttactcattaaccaacttattcattcagtaaatatttatagaacacccactatatatcaggaacgatgttaggcccaacaggtatgaagataaatatgaactgaaatgggcgcgtatggattttaccagttaggagacaatgaaacaaacaaaaacttgaatcatgaccgatctgtgatcattgctctgaagataatacaggtaggtgtctctcattcagaataacaataggggtgggtgtctgatttaaacaacatcgtcaagcaggctattttgatcttcacactgagacctaaggtaaagaaagaaaaagtaaataaagcacgaagttagggaattttttttttaagtaaagggaacagaatgtgcaaatactctcagacagcaataaagataaagaaggcctgtggactgaagcattgtaatgggtaaagaggaattaaatcagaaaggaaaggacaaactagatcatagaaggactcatagcccttaataggattacagataccattttaaatgaataatattttatacgtaaaagaatgaaaatttgaaaagctctttcatcatgtaatatacaaaccatgttgtccacataaaacaaaagtaaaagccatgagtaattcatataaaactaaaggttatcagaatatatatgaaaagcctcagtaatttgctatatttgctaccgtaagtatgcaggaaagaccatgttttcacagtaattatttctaactcctaaagtttaaacacgtcaaccatgttttccaacttaaggacattattaaatgatagtcaaccaaaggaagaaggcttcttaaattagaatacttagaatagtgaggttacagcaattcagaatactgagaattcaaatctaatccacaaatctgtcttctataataaaaataaataatgtaaaactaaaatattataaatataataatctagatttagtatttactttctaaaattaaaatatgcgtgaaactgatatagtctcatttttcaaaacagtctgaatactttaatataaggaaaaactaggatctgtattactggtgttagtgattataatgaagcagttgataacttccaaatttaaatttcacaaaggaagatttgttaggttgataaataacatccaaatgtagacattgcaatttaattaacatattacagtttcattgaatttgcataaaagttgagatggtaagaatgtgaatgactaaagaaaggtttgctatctttttttaatttatttttctttttgatggcgggggagggatggagtttcactcttgttgcccaggctggagtgcaaaggaatgacctcagctcaccgcaaactctgcctcctgggttcaagcaattctcctacctcagcctcccaagtagctgggattacaggcatgcgccaccacacccggttaattttgtatttttagtagagacggggtttctccatgttggtcaggctggtcttgaactccaacctcaggtgatccgcctgcctcagcctcccaaagtgctgggattataagcgtgagccaccgtgcccagccaggtttgctatcttaagagagtaacccaatgtcttagggtgatcatttttctcttataaacttgatgaatcaaaatataaatatatacatagtacaaaatgtaaatgttgccctaaccatacacaacgaaaaaagagttgttaagagtagcttgataatgatcctttttattcccaccaacatagatggtagaaaatttgatacctaattttcaagtatttcaaatatgaattcttttttaaataaattttcttacataaataagggatgtttgcattaaattgtgtattaattttggtaaataatacacacacacacacacacacacacacacacacacacacacacatagagagagagagacagaggctctcccaggctggagtgcagttgtgcaatctcagctgactgcaacctctgccttctgggttcaagaaattctcctgcctcagcctcccgagtagctggaattacgggtgcctgccaccatgcctggctaaatttttgtattttttagtagagatggggtttcaccatgttggccaggctggtctcgaactcctgacctcaggtaattcacccacctcagcctcccaaagtgctggaattataggcatgagccaccgcctggcctacgcttttatattttatagacagaatatatttaaattttctttcctaaataatgttccatgaacctataaactctattgaaataacaaaatctacatataactgtaccccttattagagttctagattttgggggtttttggtgatttttcatataaaaaatgttttatgtattaataaaatttccatttatgtaattgacacataaatttctaaatggtaacccctaatgtaggcaaagtgtgagagaacaagtacatccaaacattagaccatactttcacggcccaatttgatgatgtgtaataaaacgccttgaaatacacaaatcctcatctccatgatttctaattctttttttttttttttggagacggagtttcgctcttgatgcccaggctggagtgcaatggtgcaatctcggttcatggctggcgacctctgcctcccgggttcaggggattctcctgcctcagcctccccagtagctgggaaacaggcatgcaccaccacacccgggtaattttgtatttttagtagagatagggttcctccatgttggtcaggctggtctcgaactcccgaccgacctcatgtgaaccacctgcctcagcttccctaagcgctggaaatacaggcgtgagccactgtgcccagcctacaggatttctaattcttaaaatttattcaagcaataatcctgaatttcagaaatgactatgtacaagtcatgcatcccaacaataattatatatgtagacaaatataagctaaatataattgtctactaaaggggaatagttaagtaaatcctagaatgtctaaaagatagtttatacaaccgttaaaaaccatgtcacaaaagaagagttaacataggaggcatgatgatatgttggagaaatgacacaacatttggtttgttttttctgtttttttgtttgtttgttttttgagacagagtctccctctgtcgcccaggctggagtgcagtggtgcgatctcggctcactgcaagctccgcctcctgggttcatgccattctcccgcctcagcctcctgagtagctgggactacaggcgcccgccaccatgcccagctaattttgtttttgtatttttagtagagacgggatttcactatgttagccaggatggtctctatctcctgaccttgtgatctgcccaccttggcctctactaaaaatacaaagtgctgtgattacaggcgtgagccaccacatccggccaacatttggtctttaagaccaaaataattattatcaagacaactatattactcaaagcaagtacagatccattgcaatatctatcaaaattccaatgttatttttcacagaaatagaaaaaaaaattctaaactgtgtatgtaactaaaaaaaaaaaaaaaactcaagtagccaaagcaatcctgaactaaaagaatgaaactggaggcatcagtacctgacttcaaaatatattacaaggcaatagtaaccaaaatagtatggcattgctataaaaatagacacatagaccaatggaacagaacagagaactcaggaataaatccacctgtttacagccaactgattttttacaaaagcgctaagttgaaactgggcccctatctttcaccatatacaaaaatcaactaaagagggattaaagatgtaaatgtaagatccaaaactataaaattactacaagagaagataggggagacacttcagtacattggtctaggcaacaattctaaggccaggaccttaaaaacacaggcaacaaaaacaaaattagacaaatgggactatattaaacaaaagcttctgcacagcaaagaaaacaacagagtaaaaagacaacctattgaaggggagaaaatatttgcaaactattaatctgacaagggactaatatcaaggatatataaggaactcaaacaattcaacagttaaaaaatgggcagaggacatgaatagacatttctcaaaaggagacatacaaatggccaacaggtatattaaaaaaaagttcaacatcgctaatcatcagggaaatgcaaatcaaaaccacaatgcgttattatcttattccagctagaaggactattaataaaaggacaaaatgtaatagatgctgtgagaatgtagagaaaagagaactcttatatacttttggtagtaatgtaaattactacagccactacagaaaacagtatggagcttcctcaaaaaactaaaaattgaactaccatattatccaataatcccattagtggatattaatccaaaaaaaaaaaaaaagaaaatcagcgtattaaaaggatacctgcactcccaagtatgttgcagcactataacacaatagcaaagatagttatcagtctaagtgtccatcagcagatgaatagataaagaaaatgtggtagcatatagacttaatggaatactattgggccacaaaaaaagaatgaaattttgtcattagcagcaatatgaatggaaccggagatcattacgttaagtgaaataagccagaagcagaaagacaaatatcacatgttctcattcacatgtggatgctaaaaaagtttattttatggaggtaaaaagtataatgatagataaccagaggctaggaatattttaggggaggggtgtatagagaggggcataaagacaggttggttaatgggcacaaacacacaatgaaagagaaggaatgagttctaatgattgataacacagtaggggacaatagttaacaacaatgtattgtatatctcgaaatagctagaagagaggacttgatcagttcccaacacagaaacggaaaatatcaatgcgacagacaccctaaataccctgacttgatcgttacacattctatgcatgtaacaaaatatcatgtgtacaccgtaagtatgtacacatattatgtaatgactcaaaaaatgttaatgttaattttttaaaaaagaattgctattagtctcaaatagtcctaactctaccactaattaatgttgcaatcttgggtaatttatttatctgaatttcagataacttctctctaaaatgataattgtgaagaataacttatgaaattcatttgaattaagacactgtattttgtaagagtctcatgcacacattcacaggcatacaaagtattttggcataacaatgattcttaaagtaaatatatagaaataataggatgataataaagggaaccaaaaatatttcgctccaaaatatacttctttgacatattttgatatggctattcagagggtctacaaattaacgataatcctgaaagctgtcttttgtcaaggagacttgctctgtttaaaaagaatcttattagtgaaataaacaatcaagattgttctggggcctacaccttacctgcagatctaggaaattaactcaaccacagcctaccatccattatttctcagagctgctacctgtgaggtttcatctacataacaagactacctttgcccctttctctcctataacctgtcttgccatgctccaagtccctatactttttataacacaagatggtataaaaacaacaaccatctggcctattccttgagttttcatattttctatgatgctcatgcacatgtgtgcacaaataataaatttatatgattttctcctattaatttgcttttcgtcagttgattttcatcatatctatagagggcaaagggaaggtttccctacacttttggtgctatgagcaacgtaaccaaaagctcttttgaagctcttttgaagctgcagtcgagggaactcagaatctgtcaggctgacagaaaggtaaaaatttcttactagtcagatacccaggtgtctatctgtggaatccaattgagcagatagtgacagttactgtttttccttttccaaatttaagattaatgagagaaaagcatttatacagactagtcttaggttcagcgactctggtatatattttggaatattcatattgtctgatccttttcctcccagaaatagtcatgtgttttcctttgtctttgttttttgtgttgtcataaagtccctttggtcttgttttatgtccctgagagtctaccttgtcatcaaatggaatcactattttttggtctcagccatccagatggcatgattttggggtcatgtctggtagccagcgtgaaagaagtgagaaccctaagacaagtaagattttaagcagcacactctttgttctgaatttgccaacctctcaggtgaatatgtcttaagaagaagttccatccctttaagaagaaggggattttgctgtctcaagaagaaattgtgtcttaagaagaagttccatcctctaaagaagaagaaggagattttgctgtctcaacttttactacatggttagatctgggaaagtccaattgcacatggactatccattgtcacagattaatgggttagtgactggcagcttcccacaaatttctgagagactggagacatcgtatgcagaaataccatccttaacctgtggcaaaaagagacttctgctatcctaatctatttctgggagtgaattttctggaggatcatgaggcctgcatcttcgtttttaaaatgccacttatatccatggtgtgctaaacctggaaagttatctctgggactttccaagtaaaaggcttattagcttgagtcattaatagaataaataaaattggctacatttaaaagaaaaccttttagtgagtgtttctcttcaccagctctcttactggtatctacgaaaaaatacaaaaaaaaaaaaaaaatagccttaaaatctctcttggcaaaaacaacaaaaaggcagacaactgatttaaattaaaattaaaatcctttgtgttctcaacagcctgctttggtttctccatgggatctgcaaaaaaagcactccagcctgtggcctagtggctagggttctatgctcccacagctgcagccaaggtttgaatctcattagacactcagagagatgtggatgtaaattccttaacttaggagaaaaaataaacatttataagaattatataattctttttttaggtgtgggaatagagtcttgttctgttgcccaggctggagtgtaatggcaccatctcactcactacaaccactgcctcctgagttcaaggacttctgccttggcctcccaagtagctggaatttacaggtatgcgccaccacacctggctaatttttttgtatttttagtagagacagagtttcaccatgttggccgggctggttctgaactcctgacctcaagtgatcctcccgcctctgcctcccaaagtggtgggattacaggagcgagccaccatgcctgacaagaattatgtaattcttataaataactatataatttataaatttataattcttaaaataattatataatttataaatttataattcttataaagaattatataagaattagtttgaagttttgtaacttttgacattttggggtacccatttgttatagatcattttcccctccaaggagggctattgctctcctgttcatatctatgtccctttcttcttctagccatctttgggggtggctcttgatcttgttaggactgcttctttgcatctcttttgagatacctcttgcatccttgcttagtcattaaagacttactggttttgattctgagtcacttggtagataccttctgtttaaatgcaaagagggataaaaaatattcaaaagctggaatactggcagtttgtcccagcaaaaacctgatggtgaaagatttgaaaagattttacaagagctctatggtcatcagcttaattaaaagctgacattcaaactacatattttttaaacttctctgttctcttttggatcctgtttctcccacaggaatctttttcagtgaactaaaacgccatcctaattgtatgttcagtccctctgttgacttcctttcttattggcaagatttttgcttaaagaaaaaactaaaacttcattggccttttgcgaagcttgagatgtatccacactggctcctcttggactcaatgctccatttgattcttcccctcctttgccaccttcagtcttctacccagttccctttaatcattgattgttcccccttcaaacccatatttcttccattgggtcaatcaatggataaaaatgtactgaaaagaaacatgagagttacggttgtcacataaagggatcaaaaagggacttctaggaacgctgatatgccttcaaaacacagcgaaggtgccattgtctcctttttgggtaacctatcttcctcatagagccccaacagtcacaagtaggttcagccctaattcattcatgggctccaccctgaattcggtaatctagttaatttaagaaacagaaacttaaaaagccacctgttcaactaaatggatcttccaaatacaactctccaatattttgctgcccattttcaaacttcttgtaaaaaagatttacacctataagaaaactctccatttgtaagggaatctccctctctacaccaaaaccactggaaacccataccatgggaaaggcattcccttaaaaatttccataacaaacttttgtttaaggtatttttcctggctatgtgtcttaaatgggcctttacctatgcccttctttgtcttggcaaataatgaagtttacatacaagttctctgtctttgagacagaaattttctctcttaattcacctagggccatccctttagaagtgcaagtttaaggttgcctagctaacagttgcatagggcaatgaaacaggtgatctgaagattgatggtctaaatcgggtggagaagggctatttggaagttggcaaatgagaatttcaatgaaagctgcaagatttgattctgtgtctctttatgttatatgtctatatctgttatgtatatgtgatatttctaagtgaaccaacataatctttggtaaacaaagctagttttaaaattgttggtaaaggccaggtgcagtggctcatgcctgtaataccagcactttgggagaccgaggcgggtggatcacctgaggtcaggagttcaagatccacctggccaacatgacgaaaccctgtctctactaaaaatataaaaattagctgagcatggtggtggatgcctgtaatcccagcaactcaggaggttgaggcaggagaatttcttgaacctgggaggtgggggttgcagtgagccaagatcatgccattgcactccagcctaggtgacaagagtgaaactatgtctcaaaaaaaaaaaattgttgataaaatggaaagtcttcagaactatactaaatataattcagacatttttgcctgggtctactggttagccaggtaatttaaggtgtctgagctacaatttttaaggccatgaaactgctgcctctgtaatattttttatgcttgtttaatttctctgtaatctaaagctgtaaacgctggctgctggattcttccaaatccctgtaaatatctttatgtgagcttctatctttggttttgagcctctggatgctggagtctggagaagtggccatagtaagacctggaaacacatgtgtgtccatggcacgtggcccaccaactgccatgttcacacctctgtcctctgtcctgggttgtaaacctggtatatggatccaggacccagatagtccctgttcttcatacctgtcctgaatgccatgtgagtactcagaacccagggcaactggggaagacattcgcaagggtacctgtgtcatagttgcaaaatacttttcagtaaagtctttaaggcttgttatgtgaaattaagtaatagtcataaaaatgtctgtatcatttctaagttaaaaatactataacattaattattaaatataactctaaatttatatgctttaacatcttatttttatatggtatagaaaagctaaatatatttagatctgtcaattaaaaactaggaaaacatatctttcttacaaattatgaaatggttttcatctacaaacactgatatgaaacagttcaaaattacttcctaggttttcactagaaattaaggttactaagagttaatatttaaattaatataattaaatctattaaataattctatatgcaatgtgtacaagaaaagcagatatattttttggtaagaaaagttataaaaggtatgaggatgtatgtgtatttgttgagaaaataattttgtctagtttagaggtaatttaaaggttgctttaaaattaagggaaaaatgatgcagacaaaactaaatgggcatagaaagttgagggaaaaggagaatttcaaattttatgcggttaaatggataaagttaaataaatttattaatatggttgttaaattgagccttcatatcaaaaacacatattaatgcaaagctataatttgtttttttcttttgaataagattttcatatactattaataagaaataataaaagacttgggtttaccttttaggaaaacttcaaaaaaaggggaagggagagagaaacagattctgtgtgactcctgctgtctttactaggtcttttaaatatttggaaagtttgagtcccctctctatcaaacagtaaaggtttttgtttttgaaatcttttaattatcactttggctaaatcaatgactattatttcacaatgacctgtgatcctatttttgataaagtgttttaaacctctgacatgtttaataggcttcacagaataaaattttaagttgtaaattaagtgttctgaccacaaattagctttgggatgttacagaggacccctaaggcatccaaaagagagacaatccggcttatttgatttattaaattgtatagaccacactgtcaaataagaaatgatgtttaatcttctttgagttatatgtgtataaattaatatgtgtccaaaatttgatgaaattcctaaatatctgatgtgttaaatttctgtatgccacagaaaataacaaaagtccttgttagttccatctttaaccatggtcattttaagtcttgttgtcataataaattgcttattctgatgctttttgtccataaaagctttttgcaaatcctaaaatggtatgtcttcaaggaggttcatggaaaagactacaagtattcttaaatacacatttctgacaactttttagatcatacaaatgcactaggtaagaatttctaaaactccaatacaaaaaaagaaaaaaaaaactagactcataaaattgctaacctagtatcaagcagaacaagaattacatttagctgaactgatggaggacaaaactaattttttatcactgtttttgactgaaacattgttgatgctgtttactttttacagttcttttccacaatcaaaaaaaaatcttttttctttcaagttacttacagcttgtaacaattgggtagaataaacttttgtgagcacaatttaaacatttacctttctactgctctctccagaatttggaagttatttataaatattcttattttatagcaatatagttatttgtgtaagttcaataacaatctgttttattttgtaacaggacacaattgaagacactggttattttacccaggctttgactagaaagacatattttaaaatgtgaccagtctgctttgaagcactgggactgactttataacaccaacagacttggaaaaagactggcccaggtaccttgcctacacagttcccttaaaaaattcccgaccttgttgtgataagtaaattatgtcactttctgacaggcccccaagaacctcaacatattttaaggaccttgagaagaaagaaatttactcaattcagactggtattatagacacagtctttggcttggctctaaaccttaagtgattttcaaaagtctaatatgaaatttcatatgaaaaagttacagcaaagtcaacttatggcctatatgactaatcattatccttgttgcactttaaacaaataatcaggccaaggttaataagactaaaacgtattttataaataaattggtcttactatagcatacccgttactagtttccagctcactgaaatttttcttgtttgattttgagattttattattacctgcaatctggactgaatcttaaatttttagtcccctgtgattctccaatctactgtttccaatttttcatccaccattctgacttaaaaatcactagaaattaaaattgtgcttttgttaaagccctacaaactggagctggacaatctgtcataaactttgggagaaaccactatagccacttatatataaacagtcttcatgactattgaagtagactcagaaagttaactgaaacttttttttttttttttttttttgagacaagagtcttactctgtcacctaggctggaatgtgcagtggcacgatctcagctaactgcaacctctgcctcccgggttcaagcaatcctcctacctcagcctctcgagtagctaagattacaggtgtgcactaccatgcccagctaatttttttttttttgtattttttgcatttttagtacagatagtgttttgccatgttggccaggctggtctcgaactccttaactcaagtgatccaccagcttcggcctcccaaagtactaggattacaggcatgagccactgtgcctggccttgaaactcttgatttgaaatacaatccaagactgtggattcccactgtgcccatttaaaccgaagatgcttcaaattctaaaagtactaatttacagatgagtccagacattagcctttgtttttcttgtttccatagaaatgcctgttattaacgatccatttaagtgcatcgtatgtacagtcctggtttgagagtccatctgcaatgcaacgtcctagaataagaaataactgtttaattgaactgatctatcctcaggactaacagactgattcaagaggatatgagctaggttttccaatctacctattttttcttcttctttgtcaatctatctcacaatctccaacccaaatttccccatagctaccaatctttgattaatatgtgaatctttgtgaagataaagtttcaagtgggagactaaaggaaaccaaaaagatttcaccctcaaatatatttctttgacctattttgagacggctattcagagggcctgcagacaacaatagccctaaaaagctgcctttcattaagatttgcatctgttgagaaaaatctatattggtgaagtaaacaaccaggctttctcagaggccctacttatctgcagatctcagaaattaactcatccacaagttatgctatccattctgtctcagagatattatcagtgaagtttcatctgcctaatgagaccacctttgtcccatgccttccattctctcctagagccagtcttgccatgctccaagctcctactccttccataacctcaacatggtataaaagcaccaaccaactggccctttgagttttcatattctgtatgacttctctgcacatgtgtgcatgttaataaaatgtgtatgccttttctcctttcaatgtaccttttgtcggttttcagcatacctttagagggcaaagtggaaactttcccttggttctttcaatatacaccaaaaatacaaatcatggttatttatgggtaataggatttcgagtatttctcattctcatatttcctacattgaacatgtatattttgtaatttaaaatatattactccaaaatcagcactaaaaaataaaatcatattgcatatcatgtcaatgatttagatcaatctttttttaatgcaaactactgtagtaaacattctttttgtacatttttacatatatccagtgcttctctgggagaatatatacctttctaaaagaatcacatgaataaataatgcttaagccatttactttttcaatcgcaataatgtttgggtttcttttatatctgaatcccaaaggatcaaaggttgctagggtagataagtaaatactttggtttgcttgatttaatttttttctgtatttgctatactggccatcttagctcagttgaaaattgaaggaaaaaatgaagttatatttgtcttcattaagtttttatagacactaaaggaactcaacttgtattcacaatgctgagagcatttattcttccagtcagctgtatgtgttggtcattatcgaatgtgagagagccagagaatattgttttcattccattcttccaaacaccaggataatgaaacttctggcaaaaacagtattcttatttgttcctatagtcagcacagcaaacaaatgttttaaatatcaacaatatgtgggaagaattgcaagaaagtataacattagtgaggtgtgctaactattagtaatcttacagctcctgagagaattatttcactcaaacgtttgcatgccaccttttctatttaaaaaataataaaataaaatcttatttaatttacattgttcatatttggataaaaaatatttaccaattttaattgtgattttcaacagcagcccttctctccggactaaaaaaagaccctgtcactgtagcagcagtaataatgatattttaatatgatacaaaaatgcctgagataaacttatccgtcattatgccaatgaaaatgtgataattcaaagcagatatgactgctgttaacagtggcttcagcaacctgtgttttaccaccccatatcatatcatattccagtgttaaagaaacagggaccaaaaacttcatctctcctgctctaaaagttaagcatattatcttttttttttttttttttttgagacagagtctcactctgtctcccagctactcgggaggctgaggcaggagaattgcttgaaacctgggaagcagaagttgcagtgagccgagattgtgccactgcactccagcctgggtgacagagtctcaacaacaacagcaacaacaacaaaaaaaaggaaataacgtgtcgtgtctcttaaagttgtatcaattggatttaggagggcaagagaagtagggagaaaggagcatcagtgtagagatacagtgcatcttaatttgcaaaatagctggtaccatatttaaacagtagggttattgaaagactaaggaaagaatagaaaccatgatgaattcaaaaagcacaactttcaaatgatcatgtacaaagatggaaagaaatacaataagaaaaaaaagcaacagcagcaattttctaaaacaataaatggtaagttggaataaataaaaacaagtttttcagtcatcaaagtaaacatcaatggattgaattttctcattaagagacagaaattttcatattgcatcaaaaattaaaagctacatattgcttgaaaagaacagcactaaaagaaagttgaaaatgttgcaaataaaaagaaaggtatgccagaaaaaaaatcaggtaagataacactaaaagacaaggtggtttttaaaaattaacctgctacatgcaaattaaaaatgtcatcctctactgataacatgaagaaggggaggaaatcagaattctagaaaaataaatcctgaataatagataagacaaacagtattgtatttcaccacacaaccaattctacacacagtgtaaatcaactaatgcccgctaacagtagaattaatcaaaatttaacttgatacttttttcttaagaagttttagttaatcactgcttacattttgcaaatactgggtttggctagaaattaaaattaattccttagatcaatgtcaccaggtgttttttttttaaatattatttgctttaaagtatgggaattctaggcaccaaaaaattcaacaaaaaaaccttcaaaaataaaaaatctaatatgtattttacttgacaaatgataagtttgcttatgttttaaaacctataattataaattttaaatacaatcactaagaattcctaaaagacacagataataaataaggtagttttaattattttatatagtaactacataagaatttaaaataactgttttaacagtattcaacactgttctaataactgacaggacagaagtgttcctgaagtctctcactgaatagcattgcttgtttgtacttgggtgtatgtccttgataactcgattatttcctttcattacttactgcctttataaacattaataaaattatttcttctctgactgaattttttttaaaaatcaaatatttttacccttgccagttctaactctaattctcctttctctcaccactcccaaattctcacaaagagaacaatccggttccttaaaataagacatgcttataagatttttccctctctgatgagaaccaaatataatagaatgatgttctatctgaaagaaaagaaaactaaagctattcaatcagtagctaacatataaatcaaaatatctgtatattagtctgttctcatgctcctaataaagacatatccaagactgggtaatttataaagaaaagaggtttaatggactcacagttccacctgactggggatgcctcacaatcatggtggaaggcacaggagaagcaaaggcatgccttacatggtggcaggcaagagagattgtgcaggagaactcccatttataaaaccatcagatcttgtgagactgtcactaccacaagaacagttttggggaaactgcccccatgattcaattatttccacctggcctcacccttgacacatggagattataacaattcagggtgagatttgggcggggacacagccaaaccatatcaatctgattcagtaatacactcttaacactagaaagtaaatcagaaaaggctgtacaaatgtcatcaaagccatgttaggcagaccccagtctttcactggttaatgttagttgaatattaccgaatgagtaaacattaactataccatacatgtgattctgcatttatatataagctaccaagagtacctagaagtcttttggggctcactgcttcttaaaatgcatacattattttctttttaaaatgctgtcactaaattgagaagtaggaaattactactgtcacacaaacacaacaaaaatgtacactgccagcttcctctgtaatggatgcctacttatgtggcaatttaaaacacaggcagatcatagggataattcccgtgtgtgtgtacggctgagaggaaaagtatggcctgccttgacagagactgcttttaagtctttaaactgtcctccttccagtatttattcagtatgccttctatgcagctgaaaaatgttgtttcaaatcagtgagcatgtctaaaatacttaaggaggagcagctgagaatctttgcggtgactaaaacctagtaactttcctcaggacaggcattaggtaccacttgctgcttcttaatatgctgatttagcctccaacagtgacagggcaattggtgtgaaatgtcaactaaggactggagactactatttagaagagaaatttgatcatggcagcatagcaacaccaagcagccctgattttccttgccagatgactagcagacatttggcgtcatttaaattaaagaaagagcaatctccaaaagatagcttcatttgcaaaattataaagctccaataaacagttatttggggaaaaagaatgacggtgaatacattaaacatctgtaaatttagtgaagaatgaaaatccgaagagagttttcccaagctctttgtactatactagatcaactcagctgacctccatggtttactttgccctctcatatgatgcctctctcctttctcctttaattgtgtaagaggtcttgtattttaactatatacttaccctccatttctcactagttgtaattaaaagttggttaaataagcatgccttatgcttagaacttcaaatgatatacttcacttttcaattgcctacaacctatgctttagaagctagcaaaaatcacttcttgaaataccaacagaccagaatgatttttttgaaagcttgctagtctcattgctaattaaaaaagtgaatgtctgcatggtatctaagctcaagttcagaaataaaaactattctaattaattttgatctttatgcaactacatatgctgtaatatctagaccagagtttccccaaaacactcctaaaatatactcacttatgagtataaaagccccagcacactatgtggcttgcagatactctaaaattcttgtttttcacacataaaaaactaagtaattacagtgagattaacaaaaactcatggatgttacaatctccatctccattaccaaattcaccacacattttatgtaaatacttaatgcaagtaagtctagagaataaaaaggctagaccccttctcctttgttctctccatgccttcttctctttcaatccttctctccttttacataaattgtaacaattaaaataagctaccattatcacttttctataccacatctgatgtaaaataaaacagtaatacataatctcatttagaaacaaaaatgccaacctagaactacatgacctcagataatatacttaaaactttttcattctatacttcttggccttatcatatcatgtaataataatgagaagacaaataggaaaggcaatagaaagaggaagaagaagggacagaggaagagggagaagaagaagagaaagagtaggaagaggagaagtcagagaaaagagaattaaatggaaaaatctgtgtaaaacactaggcagagtgcctgacacatgataagtgcaaggcagagtgaggagatatgctgccagaaagcttgggaattaaatggatctggatacaaatacatgggcaaaatatctctataaaattgagactatcaataccaagtatagaagtatgttgaaaggattaaatgagtaaatacaaaaaagtccttagtacagtgtctagtatatcagaagcacataaaaaattgttattaagaccttctattttaaggtctcatataagatacttgatatttttagaacattttaatatttaaactaaaaacataattactctctactgagaaatcatgaggattaatttcatttcaatggatacaatttttgaatcaaaatacagttgttaacaaagacatcaaaaattatacattatattcatctttttatctaaactaaaaaatacccatttgagaggtagaaattgatatgtgcagtcacttaatgaaaatgaacatttctgcaagagtcaaacttgttactatcaatgacaagcaaaaatggctatttgaaaatccacattttaaagaaatgttctgagcacataaatataacacttgataatttatttagttatttttttgtttaagaaccacattatgttgttgtgctagaaaaaaagtggcacaggcagtaagatatagggcaataaattctctctaaaccctcttgtagaaaatgagtcattattatttattattagacctttaagttgacggacctagaatttctcagaaaagacagtgtaaacaatcaggggtgactggttcacaatagaccaacatttataggagtagctgtaattggggagtaatgagtcctgagactaaatgaataaattaaccagagaaggagtagacagtcttttgtaactaatgtctcagctgtcaagacacaacttggtttttgctcttaactgggccttgacagcgtcagctcccgtagaatacaaggactgccaacagcaggagcactcatccacactgcggcctgttggcatgctgcctgtggctggataatacatgcaagatagagcatatgagctggtatctggaatcagtaactgcaactctgaggctgattttttttttttaaataaatctggaagacagatgtttgccccaaccagcctgttaattctgaactgattatgttgccaacaacaaaggcactaatctgcagagaaaagtatgagtttttgacattattataataattaaaaatatatctatcatttaaaattaagtcctacttacagaaccatatttaacttattatactgagtcaaatgtaacttggtcgctgtcatttaagtctattagaaattctgttatttaaaaataaacaaaaaagagagaaggaattaatggaagaattaaagatttctattttgttaaaaggaaaacaaacaataaataatgcaccatctgtggttttgagggagacagggtctcactttgtcacccaggctggagtgcagtggcaccatcatagctcaccacagccttgaacttctgggctcgagtgatcttcccatcctagtctcctgaggagctgagactacaggtacatgccaccacacttggctaattttttttttttttttttttgagacagggtcttgctatattgcacaagctggtcttaaattcctggcctcaagcaatcctcctgcctcagcctcccaaaatgttgagattacaggagtgagccaccacctgactcccatatgctgttagacactacaatttcacttacatgacttaagtataataaagcaatcaaaagttttctcatatatgtgtaaagatgtgctataaacagtattcatatcacccacataaaaaataaactatcagtaggagatagctaaataaataatacattcacaaaattgaatactataaaattagtaaacagattttatataagttaatggcttatataaagccatttatatatatataaagccaaaaacttatataaagattttatataagttaaagtcatctatgacttaatgaaccttttagctctagctaaaagcacattgttgaaaagcacagacataagtcagacatacctgggtataaaacttcctctacctgacacttgagagtgagatgggtgctgggcgcaatggctcacgcctataaccccagcactttgggaggccgaggcaggcagaacattcgaggtcaggagttcaagaccagcctggccaacatggtgaaaccccgtctctactaaaaatacaaaaattagcccggcatggtggtgcgcgcttgtaaccccaggtactcgggaggctaaggcagaagaatagcttgaacctgggaggtggaggttgcagtgggccgagatggcaccatttcactccagcctgggtgacagagcaagattctgtctcgaaaaagaaataaaataataaaataaaatagagtcttaccccctcctcaaaaaaaagtgagatggctttcgcctcaaaatgtaacagattacagactgtaagaagactgtatcttatcttcaaacacaataacatatcttcctcataaggttattctgaagatgaaatttgatactgtgtataaagcacttcccacaatgtctggcaataaagatggctcagcaactgaaagccatcattatgcgccaaaaacactaagttgtgaggaattgatgatagctcctaccatccccaacgccccccatgcacatacatacaaaatgagatattcttctaaaaagaatgccaatcaaattttagtgtacacaggagagagaaaagaaaacatgtttcaattagacaaggacacagatgttaggaatcatttcttaaaaaacaagctaagtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaacaagctaagcaacaataatggggttttacaattgtggaagcttaatcactaaaaatatttgagaaaagaactgccaactcccttgccttggtggcttagacattcaactgcaagagatgaaaagaccagaaaactgaaattccaaaattcccaaattccatcaagatttatgattttgggccgggcatggtggctcacacctataaggccagtactttggcagactgaagtgggaggatcccctgaagtcaagagtttgagaccagcctaggcaaaactggaagatcctggctttacaaaaaaaaaaaaaaaaaaaattaaaattagccagacatggtagcatatgtctcgctactcaagaggccaaggcaggaagactgcctgagcccaagaggtcaaggttgcagtgagccataatagcgctactgcactccagcctaggtgacagaatgataccctgtctcaaaaaaataataaaaataaaatttaaaaagatttatgatccatgatactttaattaaagtgacagagcatttcatcattctaatgataaatcgtatcaggagattttttaaagaatcatagaaatcttatcttgcgaatgcagtttttgactttagaagctttaaacaattatgaagaacagatgcaaagaacacctgtgtatataaaaaagccaggatgggtttgggcatctcacaacgggcttctaccttcatgtcattcagtaaaagttagcaaatgaatttacagaggaaggtttagagtttatttcattctgtggggagataataaggggttaacaaggaaaagggaaaactaaatatcaagagattaaaaaacaaagttaacatttaggaatcagaacaccacttttagtccaactctataaatggctaaatgttgtttaatgttaccaaacattacttgatcagattgtctttgaatttatgggataccatgaagttctctttaaagattccattatgtgaaataaagaggttggccttggatcagcactgtttctctatatttactttcacccaaaacactattaactagcacattcagatcagagcatttctgttgaggcgagcttgctatgttgttaaaaaaaaaaaagaggtgaaatgacatacggatttttttctttttttgcctcactttgggattatctttcaacaatcatcaaggatttcacagactctcaagtccccaagtaaagtttgatgactatcatcatagaaagaacactgtacaagtagctgagaatcccaagttctggttctagctctaccactaacgacctatgcgcaggaccagccagctttggtgggtgtgagacctgtgcagtcagacgaggctgactgactcagtgaggactccacattcagaaggaccccatgtttggtttcattctctgatgctgccattttgaaattctaataatttcttaacaagagcctcaaatttacattttgtactaggctctacaaattgtgtagtttttgcctgtgtgagttttgcaagccacttgagctaattctcattttgctcaaagtaattacaaacccaacactccctttcccccatgctgcattaccagaacataaattttacattagatagtgctttctgatcctaaagccaactcaaagaatctcatttccaagagatttcatttagaagacagagcctatcactgttgccccaaccctttccttgtctgaaccttccattaaataattaggtgccctctaccattaattgtgctttctatcttaaaggtatatttgattaccacatttttttcaaaagtgcctttgttcaaatactcatttagtgctgacactactccatggaatgtgggaggaaaatgcactctctagcactgagagatttaaaacagaaagtgtggttggctgggcatggtggctcacgcctgtaatccccgcactttgggaggctgaggtgggcggatcacttgaggtcaggagtttgagaccagcctggctaacatggtgaaacccgcatctctactaaaaatacaaaaattagctgggtgttgtggtgggtgcctgtaatcccagctactcgggaggctgaggcaggggaatcctttgaacccgggaggtggagtttgcagtgagccaagatcgcgccattacactccagcctgggcaacaagagccaaactccaaaaaaaaaaaaagaagaaggaaggaaggagttgttttaaaaaaaaaaaaacttcactgctaacctttaaataatacattaatcagaacaaaatgttacgaaaattaaaatgctgagtgcggtagagagtatagcacagttacaggtatatggatctgtctccttagtgtaattcaagaggtcgtaaacacagcacttagtgtttcaccatcacttctgtttggccccaaattcctaccattataattattttagacttaaaaatccataaagatgctgctccagtgtgtaacgtaagagaggaaatgtgatggtgtatctggggctttccatttaccacattaacaaatgatatcaagcaggacaggtatctcccacttaagcagtaatctgcttcagaaaaacctgatgttctgagtgaaaattctgatagcctattatttattaagtggaagaaaatagagcgtttttatatcaacctaaacccctcacaaccagcttttaaccacctaaagaaaacagtaaaatagacactcaccaaatgccaaggtgcgtggacaaatgttataaaccatatattaaggtgtaaagggctacaagcatcacttcctgctcatacaatgaataagatgttaacatacagtgtcgtaggccctacttggcctttcgctgtcagcagaaaacatgcacatctccttagttggcacctgcactacatttcaaggcatctccacatgattctgatgttctactaactgtaatgtaaatcacatgttattttgttaaaaacattgagattggaagatgtaaatgtaagtaggtgccttataagcatcagcaaaaagcaaaacaagaaacaaaaacatcttagtgagagctcagtctagcctgtggagattggatttcaaaaatcaggaggcaatccactgggcaaccattcactggaaaaatattcttcaggttatgtctgaattttattcggtagctaaactagctaaactacactctaggtaggtgttacaagctgtagggcaagcaaaataaatgacgttgctgactttaaaagacttgaaaataatggtactatgagagcccagtagagcattaatatggcttttttagttataataagtacatgccaactggacagactgctttgatttaactggacaaatgacagacaaataaattttggctaagattattgagatgccatggagctgagaaacatgatgcagccacctaaaagttagataacataaacacaagaattccagaccaaatctctcactctatgtaagatttggtgaagtcatttaatctttcttagtttcagctatgtactgtaaagattagatgagttaatgttgtaagcttttaaacaaatgacaggacacacaagggaacaccaagtatttttgtagatacagcaggtcctcgaataatgtcattttgttcgatattgttttgttataacgctgatgagaaaaaatgaaaatcaattcccggccagagcactgtctgtgtggagtttgcatgttctccccatgtctggataggtttcctctgggcactccagcttcctccagcatcccaaagatatgtacattaggtaaactggcatgtctcaattgccccatgacaagtaggtgtgggtatgggcatgagtgcactcagtgatgtgatgatgtcctgtccagggtaggttcccatcttgcaccctaagcttctgggagaggttccggtcacccaacactctgaactgggataattaggtaaataattatcttacttgttcatattaatctttcttaaatgtacgtatagctcacatttatttcagtgtttaataacagaagtttttggtgtttacgtaaaagcttagtgatatttttgtgaccaagaatatgccatagacacttcacatttgcttatatcaattagtcagtgggaaaattggtttgttatatggcgtgtcatttaaagtcacagtttccaaaaacccatcaatgatgttaagtgagaacttactgtatacacagctgggtttgaattctttgccagctgtgtaagcttgggcaaattattgaacttctccaggctttcattctcccatgtgcacagtgaaaacaactatatgtactttgcagaacagaaatagtgttagaaatatatggaaagtgcctagcaaagcatctggaccatagcagacagtcagtaaatgctactgattaatttgccccttactagtaaaactccgaaaactttcactcttctccatctaagtaaccagctcattgactcatgcctctaccttgtttttacccagaacacttaacttcttaaatttctgtcccttaccacaacttcttgtttctccactgttccttacaaacttacactttatccacataaaaatgtctactacttacttgaactcttatttcttgaccattatcagatcctatctaacgtgattcctggtttcaaatacttcaactaccattgactattctcaaatatccttgatgtttacaaagtttactttgccaatcctcaatcctagatggattcaacagtctttttcattctattaagtttgtgcaaaagtaattgcagttttctactcttcgtattgcgccaagccatattagagaaagctgatttgatatgaatataactgttacattgaaaggtggggctccatataaaaaatgccaacagaaaacaatatttcctttcctctcctctgcttctttaaaatgaattttctctagaccatcttccataaaactcatattaaatcctgaaaaagtcttaacatagacatcaactgatgggatatacattgtaattgagagtttgcccaattttgttcagagaagcagtggcctagctaaaaccacatttcttatcccccttgcagccaaaggttgcccagtgagatagacacagaagtaacagagtgggatttctgcaaatctcttgagttgcctacctacgtatatcttattacaggaggaaaaataaatccacactctgtttaaatcacccttttgttgtcttgtctattaatcatatttgaacacaacattatgcctttcaggttccctaatttttccattcaccattgtatataaaagtgttactgctaaaagcagtctcagttaatcaattaaaatatctagtctggaataaaaatcaaatgtctaagcttaatgtaaaattcatttaaaatcccattaccaggttagtactgcttcagaccaagaaacttcagatggagaatgtggtagaggtctatggccactctctgagtttttcctcctgatttcatcttgacacttcttagcagctcaaacacggtgatttcagcaatggcactaagagaaagttggcaatggatggcttttcttgactataattatgtgttgttactctctggggctgatcgatgttcaacactgacttgttcccttattaagatactttcctagttgtttggaggtacccaggacattcaattgcaatgtcatgcttctgagggtcatttaaaccccagcccctcagctcccatttgacagtgtatttctaccctctttctgctaaactagttttgttcccggagggaagccctgttgggtcctatctgagaccagctccatctcactgccttgtttttatgtaagtttgtgccccttgatgccgtgtctcattgccctgtcactgggtaaacatgtcgagccttagcacttcccttttaacatccacaggcatgtatcaaatccaaataaataaaagtaatctcaattttgcaaaacaattagtggattacctaatcccttcaccactcagactcaaaggcctggataatttataccctccagatagattctggattaatggtcaaaatatgcatatccacataaacacacagagttttcagaaagctctttgaaattcatatgtagcttgggcctcatttttattgggcctcatttttagaacatgagggtgttttatatcttctgattgttctcagtgttaggaaggccctagattttattcctcagtaattttacttacccataatagactcctttcaccttttcttactttgctctcccaaatcttcaacaaaaactgtctttatttatatctaataatattccttctgtcccaagtgaaatattccgccatcttttcaaagaaaattgcatgacctcgatcttctctgtctgctttttctggaatcatccttctacattcagactattttttcttattttcaaatttcatggatttctgcttttctagctataagcatgcttatatgtcctccagtctcaaaaatagacaagaaagaaatacattctttagtagtactccacattttccttcactgtcctaccaaacttcatgaaaatccagataaatttcttgccaatgtctcactttccaataactccttaacactacagtctttattctgttccagtatattctattgaatctattctcacaaaagtaaatcaatgacccctaatagccaaacatgataaattttgtattcttctttgagtctctaaagaatttcagaattccttcctggatccccttctcacttctttgtatctaatttttcttgagtttctttccacattttttagttaaaatccctacagataaagaccagaaagctacatttttctaaaatgttactggcactgctgacaaatagaaatgatatagaatgactggcctaagagttaaagaaaaaaaaaactatttggttaaataacaatcatctagcacttccaggaaaacaaaaacaaaacttactttaaaaatcacttgaaaacatttgtcatgttcctttttttgttatctaatcataagctcaatatcaaggttgaattaagagttggagtatattacagtatttaaagcttcaaaatagattggagcagctttaattaaagttaccaggacaaccagagggagacagaatatgccataattggaaaatgtcaccagaaaaatttgtttattataaccttgatcctattttctttgagcaaaatgcctagagaccttcatttactgagtagatccccttggctgggctggttggtgaacaatgagaccacagatttcatttatctccatctctcagaaggccgcattggaggttggattgctttgttgaaaagctttctcctgtaaattgttcattaacacttgcagatatttcagcctagttcaagctgaaatgtatgttcataataatgttaaatgattatatcttttttgcttcaaaacattgtttgatttgagattgcttaagaataatccaatgatattagttatataatcattgcagggagccagttcctgagatatagacgtagcaaatgtcagaaaaaaaagtcatttagcagacacatcttggaaataaaatagttcaaattatgaatgtgggtttagaggggaacaaactggattttagacagaagtcataaagttgaattctaccactacctcatgctatctacacagtcttggataagaacattggtcttctgaatttcctcatttataaaataagaatgtataaatgtttaatgtgtctacttcacagagtttctgtaagggcctaatacataagagtcatcagaatcataacatgattttatatagtaacaagcccccacccccaacaaaaaaaaagcaaaattgctatcaaagagatagcaactaaaaggttttgatatcgttttatctttcagctcttcataaggctggtagatggagctgatcaaaagacaaaagcacaaatgagtgtaaaataaagttgcaataagtagtttagagtcaaacatataaacaaaaacaagctagcacataaggcaataagttaaattgactttttattcaaaaatattataaaagataggattaacaatttaatcttcaaatacataaaatctgtgttcatgtatgcacaataacaattactgcagatactaaaaagcaataatttcaccaaaaaaccctccactttttaacttccttttttcaaaaacctgaattatcaaagactgttaagtaatttctttagtaggcttataagaaaacaaccagctacatttatttttctttcacagtgtttacatttatattttcaaagatatcttatgtttactgaagaataatgaaggttttaaaattttccaaactcaaataaaaatgaaaattgtttaaataccatatattttctttcactaaatcattcttttgaaaatggttaattgatacaggattcactgaaaaattaatagccttccagaatattctattatctagatcatcgaatgcttattcagcatggatgaatagaactttacaaaatactacttagcttcatttcttcctttgtataattatacacttctttaggtcaaaggatgtatttatgtaataagtaggaatgtagatcttgaagccagacacacctgaatttgaatttcacaatcaaattcacattcaaatttcacattcttgctgctcaaagtatagtctttgtaccaggagcataagcattaccttatgcttggtggcttataagaaatgtactatctctgtcctgatctactgaataaaaatctgcattttaacaagagccacgggtgatctgcatgcatattaaagtttaagaagcactggcaaacattacttattagatatatttccttgggcaagtttcaggaactctcaaagtcccagtttcttcattgaaaaatgagactaataatggtgtctctaccatagtattattatgggaaataattagataatgctacttagtaaccactcaataaagcctaactggtattaaattttatcatctaccttagatttgtatattcatgatgttttccactgtatttacctataaaattacattagtgtcccacccagaagaaataaagctcctttaatccagatgtctccctgagtataagcctacaactaaaatagaagcaaattaacaatgccatcttgcattcatttacaatacaatgtagcatatgttcttcattagcctcaaaatatttctctttgaaataatgttttatatttttgtggaatcaaggaagttaagcaaagaatttagtttgaaaacaaacatgaatctgtctccctgaaataaaattgaactattctacacttaattagccattgtgtcttcagtattctgtcatcatgtgcttaagatattctactgatccctcacaagactcaaataatgcaccaggtgtcttgagcttccattccaaatgagaaataagaaagaaagtctcaatagaattctattttaatccaattaaggcaagacacactatttcattccacaaccttttttaagagactatgatgtccaaattacctgcttcctacatccagaagaaaaatgtagactgataaaatcaatataaatcgaatcattttccactgtcacctgaatattaatcacttcagtagatagcaccttatttttattagataagtttttattacaaacatttacttaaataaaaaagggtattctctctccaaaattgaagataataatgttttcattttccagtaatgaaagtttatcttcctatgaattactcaattactatttttatttatttatttacttatttttatttttttgagacggagtcttgctctttcgcgcaggctggagtgcagtggcatggtctcagctcactgcatcctctgcctcccgagttcaagcaattctccctgcctcagcctctggagtagctgggattacaggcacctgccaccacacccagctaatttttgtatttttagtaaacacggggtttcaccctgttggccaggctgatcttgaactcctgacctcagctcccacctcggcctcccaaagtgctgagattactggcatgagccactgcatctgacctcagttattattttcaatgaaatgtttcaacctctagcaacatggtgtaacaaaaattccaaccaacatacctgctacactacaacaatatcttggatatttgaagaagcataatataaagaaagaaacgaagcatagaaataaaaaagaaatataaagaaagaaagaaagaaagaaagaaagaaagaaagaaagaaagaaagaaagaaagaacgaacagaaaatttttgagggtcaagatatttataaaagatagtaaacaaaaaaacctgaacaatgagtattaagcaaacaggaaattcagagttgtattgagataaatatccataaatgtactgaagtctacacaataagaggaaccaggcggggtgcagtggctcatgcctgaaatcccagcactttgggaggccaaggcagtaggatcacttgagcccagtagttaaaggcttgcctgggcaacatagggagacctcatctctacaaaaaattaaaaaatagccaagtgtggtggtacatgcctgtagtcccagctacttggaaggctgaggtgggagggctgcttgagcccagcaggtcgaggctgcagtaagcagtgattgtgccactgcactccaggctaggcaatgaagtgagacgctgtctcaaaaacaaacaaagaataagaggagctaaactgaagctccagcattatatctaacaaaagatgtataagaagtttatgaaaaaaatttttaaagtttatcaaatggtataaaatactgctaaataagagatactatttataaatagaaagacaaaatataataaagatatcaattcttctcaatttggtctgaatcaatataatacaaatcaaaatcccagtagacattttcctggataattatatgccaaatctaaaatttagataaaaggtaaaagtttaagaatactcaagattattctgaagaagaatatagtgagggacttagcctatgtatttagtctgttctcacatggccaatgaagacataccccagactggctaatttataaaggaaggaggtttaattgactcacacttccacatggctgggaaggcctcacaatcatgacggaaggcaaaggaggagcaaagtcacattttacacagcgacagcaagagaacatgtgtaagggaattcccctttataaaaccatcagatctcatgagacttactattacgggaacagcatgggaaagacccgcccccatgattcaattacctcccaccacatccctcccacaacacgtgggaattatgggagctacaattcaagatgagatttgggtgaggacacagccaaaccacatcagcctactagatattgagctggacaactggagtttactaggggaaggcaaactaatttataaatgccctagaaaaattccttggaaaaaataatttgaaatgcagactaaaattatatactcatataacttgcacgtggactaaacacataaatgcaaaagacaaagcttagaatcatggagaatgaaataaattatgtgtataacctcaggttagccaaggttttcttaaagaaaacactctacaatactaataattaaaagaaaagttgactttgcaataaaattaagatgtttgcatcatatataactaaaatgaattagcatcaggaatacataacctacaaatcaattttttaaatgtacaaaaaaatttcactgaagaggaaacaagaaaggtaaatgaatatacagcaagatgtctccctcattagtgacaagcagaggtaacatttacacccatttgattgcctataattaagaagtgtaacacttccacatgtcggccagaatatgtatcaatgtgggctcatatataactagtgaaggtctgaattgatacgattattttggaaaacaattgtcattttataaagctgactgcgaataccctacaatctagcaattctactctcctgtattgaccctacagatattcttacacataagtactaggagacttgttcaagaaaattcagcagcactattcataatagtatccatctggaataatccaaataataatttacccacctacagagactaaatgaagaaattgagatacatcctcataaaatatttaactgaataaaatgaattaaatctaagtgcaaacatacatataaatcatacaaacacaatgttgatggagaaaaccaagtagctgaagattacatacagtgcaatatgaatttgataatgctaaaaagtaagcaaactaaagaataacttgtttagcaaagcatttttgtgagggaaaactatttttaaaaagaaaaaaaatggtaacttgaatatctagcattttggccacctctagcagagaggaagggtgatggaataagagactatacaactaaagaggatgataatattctgggttttatgttgtgtaaacatgttcaattattattatgtatcatgatgtacatatggatttaaacatgttcaatttattattatgtatcatgatgtacatgtggatacatatacatataatcaattaaacacagattattaaaatataatagtaatataaaataaacataattagaaatattttggggtttgcatttaaaccatgatatctcattttttatgaacatatcagatgaacacagttactaagaagaagaacgcataccaaaacccctcaatagagcatgaaaattaaataatagataagtaaggaaaataataaaatgagcagatccaatttaaactcaccaccagggctttagatctgttgctcagaagtttctcaatatccctggctgcaatttctaccagctggcgtgcattatttggttccacagtatacaaatcttgatatttctcataaatctgtgtgaaagaaaaaaaaaactagtaagaacaatagttacttatttggcttacaagttcccattggaatgtatttaaaactataaacaactgattagaaacaccaccctgttctttatcttgatctttttggagtttgagtgtgtcaggaaaaaatatgtaaatataaatttgctctaggaccaccagcttgccaaaatataggttatgttaacaggttgtaaaacatcttgtaccacagtggtttgtacatgcaattttgaggcttgatgctgcactctccaatctcgaaactgggtattatctgtcatcagcatcgtaagagaaagggtagccatcctagacaacagaaggcgaaatggagcatgggaggtcaaacctggaggagtgtggaaaacaaaggcaggaggaagggttatgtgctacagaacggagagagagagaatacatataaagcccctgctaatattcatctagataacaagaggagcttaggagacagttcacatatagaagagatgaaggtcattaaggttttggttagaacggtaatggagtattttttttaatcaaagtaaatgttgctgttagtttttaatcactgaattaaagtatactgaatttaagctaggtgccaaaagaaaaatttgactacctttctggctcaccttagtgtctatggaaggatttccccagagtggcataagttgcacctgtcttacacagcctgtacacactcagcaggagaggaagaattaaagaaaggggggttggaggggaagcagtcacagtgtttgtggctggagggctgagatgagaaggaaatccctcatgcatccaacagatggggtgcacatgcatgactaaaccatctttgaaagccaggacctggcaggtttttactgtcttatgagaagtgaatccaggcacatacaggaatcagttcaaccctgcttttttctggcacaactccagcattctgctttactaccaacaggttctacagtatgatcccagctgcgcactgataacactggtgaatactggcttcaaatggacacagatacatactaacatttattgaccacagagcatattagttttacatggacttataattttttatttgaaataaaaattaatttgaaattaaaatttattggaattaaaattaatattttgtaaagatttaaatcaatttttgctcctaaaagtgacttattcacactatgagattttaccatactcatgtgaactttgaacttataagttttcactcaaagtactcaaggcacgttaatttagtgataaaatctccatatttggattcatccaggagtcctgcattttactggattgcttatgctttctgctaagaagcagattattgaattctgttttttaaagacccatatcatccatgaagaacttcatccaatgcaaagctttctctttcatttcagactaagataagatttaggaacattgattaattgatttgaggtacaaacagataaaccacaacatcactttaattgatccaggatatgtagttctttgcagtaaaaccaatagagctaattggtgtgaaatgtagtgtgcattgtaccattaataccttgttcatttctctatgcagtctaacctccttcctgtggtatagggaatacaatatgcttcatagttggtggggattagttcagatgtgcaatctatacttcaggtaatatcatttattaagtctctacatacatgtgccggacatattaattacttggtgctttaaggaataaatagattataaatcagcagaaactatttcaagcatataagtatcttctcaaatatataaatttatattctctcaaattttccttttaggataatttttaaatacttaacaaaaacaagatgtaactcacaaataaatgtgaaataaattaagtcaagaagttaaagtctagaacccctagtgtaaatatctggctgtattattttatatataaaaccacaattgaattgctttctttggtaataaaaataaattaaaattatataactgcccgccaaaaaaactagctcttgcttctggttccaaagactacaatcatctttgttgtcatgacagctattgcaaagctctcctgatatatgtttagtaaataattttcagaatagaaggtttcatatggatttttatgatcacacaatatattttcataatatgtgtatatttctaactctttccatcactaagacatatttctacaatatttcatatattaatatttcaaacatatcttgaggtatcttttcctcttcttcagtttactgttttgtaaataattatctgctttgccattttgtccaatttctttctcgaaggaaaaacagcatggtggaaataatacgagtttttggcaccagacagagttacatttcaatcctgtcaactcttcacatgctgtgcaaaactggccttcgttttttctctactagaaagaatgtagcatatagacagacttaaaaacaggatacttttcctcctgatacactcacatgctttagtttccctaaagttgaagttctcctgctgccaccctgacataagtcttaacaaaaagaatacttgtcacctgtacattctttctttcctacaatcttaaccaactggctttaatgtactttcattgtaacattcaaagaccaagtttctctgtgatgacaacctagattatggtttgtgagatagccaaaaaaaccataatctatgttctaaatatctttgttctaattaacatatgttaattatgctaatcagctatgttaacataatatatgttctaagtcactttgctctaattaagtctacagttccaagataatcatcacaattatacattttaaaataacttcaaatttaatatctaaaaaatgatattactcaatgatataattgcttaacaaaattcctaaagaaacctcttggaaatcataatacagatgccccagaaatatttactcaaaactaaatatgcttccaaacttttagaggacgtaaaaattttttaaattttttatttaaaaaaaaaagttttttagagacagatctcactttattgcccaggctggggtgcaatggctattcacagaggcaatcctagcactcctggtctcaggtgatcctcccatgtcaaccttccaagtagttggaactacaggtgcatgccactgcacccagctagatcattattagcaatcaatgtaggcagctactctatatcactttcaggtgtttcacatacattatattatttattcactttaagaaatctataatatacatttaattaaccattgtattagtgagaacaatgggattcaggcttcagaatatctggagggagtctgaatcacacttcatcataaaagagcaaaccaatgtctagagcagccgaaggtgagtggtaatgtggcatatttaggcaaagtgaatcttcaatgccattctatgtcctaaatcttccttggcttcagcaggacatggaaatttaagaaagccctttgaaatgagcaagaaaggaacaagggtcggtatgtctgctaggagataggctccgtgcaggatcaaagaaattctaatgcagaggctgagagatggaaagtgggaagcagacacccagctgaaggataatggtaaagaaccacctacagctgaggggccctaagcaggttgagaagattggccaagttctaagtagcagtcaagttcactatctatatcaagagaacaaaagcaagcaaatacaccagataccttgtcatataagtttctccctgcgcccaggcatggagaaacaaagtaaagaagattagagaatatagaaaaagagttagaacttactaaatccttagttgaccacaaaaggctgttttgatctgaaagaggctaaccttcaagtgatgagattaatttttccctctcctaggaaagagaatgtcagctcataagcaagttaagttccctaaagagaaacagtcaaatttctgcatattaaatcttaggtatgtaaattttgacaaccccatttcccaatacttgcacctgtactttccttccatggaaattgtcttggacaagcaatcaagatttctgccatatccacagccatctttctgagggacattttccctttgacaatccctgatgaaataggagctcccttacacatggctagaaatattctaatgtatggccttgtctttgacttctaaccaattgtatcaggacttatattagacctgcaagaagttaacttctgagtcaatggcatgtaacgagccaaatataaaagacctgtataaataaagataacgcactgagccaatcagatgctctcaccacaagatgacagttggatgaaatagcatggatcaaaggtttaagtagaagtagaactgaagagactagtgggaggaaaacagtattcagatctactgagcaatagaattggtggttatgatagacagaataatggcttcccaaacatccatatcctaatccccagaacctgttaatatgttgttacatagcaaaagggaattaagtttgcagatggaattaaatttactaatcagctggacttaaaagaagattaccctagatagtcagagttagccaatggaatcacaaaggtccttaaaaatggaagaggaagatgtgactaaggaagagtaaactagggaaatggcagcatgagaagaaatcaggccaacactgctggctttgaagaccaagggaaggagaaatgagccacagaaaggacttctcatctccagaattgtaagataatgaatctgcattgttttaaaccaataagtttttagtcatctgtcaccatagcaatagaagactaacataatgagttagctgtgaagagctcccagcagagtcaacaataatagcttctgaggctgccttgcctctgaactgcccttcctctgaccaaactattttctaaataacttgagttcttgctgaaagccaggctcctcctgagttcgcttaatttggctaagtttgttttttgtttttttttttttttaataggatctcactatgttgttcaggctggtcttgaactctcaggcttaagcaatcctccttcctcagcctcccaaagcgctgggattacaggcgtgagccacagcacccagtctatttttttttttataagtagattgataataaactttctgagtgattcactattcctaataatgaaaaattctaacagaatcccatgtctgaagttgtgattaacattatttatttattataactttgcattttcatttcatttatcattagattctgatgaatatgaaagatgagctccattgtgagcaacatacaatttccattaggcatcaggaaataatgaaattagttcaaggatacccattattaccttcacaattgtgtgaggttctaagaagaaagatgacagaaaagctaaaaatatcgaaatgaacatacatacatacattgtataaaactagacaaactggataaataaatatcatcctacctcaaaataatgagaagtgggattaaaagaaagtgttacattatatttcccaccatcattctaattccactctctattgggtaacaggagtaaattcaatatcttcaatactaatgaaggcaagaaaagggattcattgtcacctctgctgcttcagatacccacaaaatcaatttcacttaattttagttgaattttgcaacgtgggatggtttgtctgtgggttatacatttttttttcctttattaagtattccttgggctttcgaactacttgttccctagcaactaagaatgtcttctttctaaaaggtgtattaacagaaaagaatgatataatgtactttctcggtcactttcaaggatcaaagttcccttaactaaacaaatactaatgtagtatttttctatatcattaagtctcttttttctttatcataagtctcctcatcatctaagctggccatcacacagaaatgttgagaaatgtgaagattccttcacctaaggtaaagagtaactagtgactgtagatctgaattgatgttagaatatactttaacaacaacaaatacaatacaaacaaaacctccttttccccatgaaaattagctgttttaacaaaatgaattttgccataaaaattatttaatcatttctaattagtccctgatctcttcaacctcttccttccctttgattaaaataataaatgatgtaatctactaaataaaaatcaagcttttaaaatgtcttactctttagcatattgtcgattgtgtttagggctgctgggtaaagaactaatgcaaataccaactgctaaaatgtattaattcaacttagtgtgtgcatttatgaaactataggtaatcattttacaagatgcatgacactgtattaatgtcatttttaaaaatcacatttgagcacggtggctcacgcctgtaatcctagcactttgggaggccgaggtgggcggatcacgaggtcaggagatccagaccatcctggctaacacagtgaaaccgcgtctctactaaaaatacaaaaaaaaaaaaattagccaggcgtggtggcaggcacctgtagtcccagctatctgggaggctgaggcaggagaatggcgtgaacctgggaggcggagcttgcagtgagctgagatcgcgccacggtgctccagcctgggctacagcgcgagactccgtctcaaaaaaaaaaaaaaaaaaaaaaaaaaatcacatttgattctctgcatcttcactctaagtaaattatggccttttttttcttttccctataacctagctttttgaattgggacactacctttgaaattttttatgacttgatatttctattttgctacttataagcatgtgcaaacatcaaagatatataatttatatacgtgtgatgtttattgagtattttctattccccttcaccacaaggtaaatctcaagaagacaaagatttttgtctgttttgttcactggtacgtaaccagcgcatagcacagtgcctggcacaatcaataccaattgcatgaattagtgaatggatactgattctctgtcaggctttgctgggaatgtgaataatgatttataacaacttcttccctgtattttaaaatcagtatttattttaaacctaaaaaaatcatggttaagtaagatgctatgcagttacataatagactacaaatacaacaccgatacaataattaaattccaacaatagaataaatacacaaattaaggtaatgatcagtgtgaggaagaatatgagtgttccaatgaagagatatagaaatgtatgctgtcagaattcagaggaaattaagatcacataggatgcaatagtcacataaatgaaactacagccacgttttggaggaaacgtgattcagtaatggatgaaagagatcagaatgggtgtaatacaaggagttatgggaaaataaagagtgaaaggcaaattgagacataattatgaaggatggtaaaaggatccttcatataaaaggatggtttatatcttattctctagtctacccaacatattttagactagtaaactacctagctcagaacttctagtggctatcacagcaattagtacataggaagaatctgaattataaatttgtttactacaaacacaatccaaacatatatatacacacacatgcaattatatacataccacatatacacacatatataaatgcataatttggtcatagcctcaaatttatagtgcataattttccaatgataactatatcaaactagcattctaataccaaactcacgagtctccctagccactctattctttctatttgctgtgatacagcttcttagctaggactatagcatttcaaatggagcatcgtctttagaaggatatttaggaagaatgaagtcacaattggtgagcgttctgcagcacacactgctactcgccctagctcctattaacaagaacacgatggtgatgcttccgagcaatatattaaagacagaagaaagaaaagaacaagtgacaatcgcaaacaggccacttaattttctccatgttatacatagaacaggtgattatatttaaccagaagtgcaggttgtccctagaacagaaaaactaaactataacaaagactaaagaattttttggtttttaggataaacgcatttgacacaaaaagtaaattttaagttcatgtttaagaatacttagattcaaaacaaggaaaacattaacatacacaaataacagaaactctctacctgtttttttgttgttgtcgttgtttaattctggagataatttattaacctagcctctctttttccatatctgaagctatatataaatttgaatacacattttggccagaaaattcatatgcaattagaagtgaaaaagatcatactaaattcattaaaactaaatttaaaaataattaaccataggctgagtgagctgcctgtttaatgtctctaaccccaaacgacctaaatatatttcactgccaataaaacaatttttaaaagcagcccagtttaatttgcccataactgtcatatcttattaacaaatggcttttctaaagcaaaactgatatgtaccaatgctgatacacaattttacaaatttatattcatttaaagaatttcatacactcagattcttcagttcttcttgagcagtttttcaaccttagtacaattgacattttacagataattctctgttgtgaagggatgtctcatgcattgtaggatgtttaaaagcctcattggcctctatgccaacagtatgcacgtagcaaccaccccatggccccagttatgataatcacaagtatttccataccatcccatgccctgagttatgataatcacaagtatttccataccatcccatgccctgagttatgataatcagaagtatttccaaagattgccaaatgtatgccagggcacaaaacagcccctggctgagaaccattgcactaaatatatgtttagagtaacaataaataataacatatccctcaagtactagcataacttcagaaaatgttaattaacggccggaagagaatgggaaggtaaaagaaaaaacgttttaatatctgttgagaaaatattgaaagtcaccctaaaattagaaatcccctgagtttattctgtgtctttgaaaatgaatgtaattaaccactgtttaaacaaaaatagcttcttacttaaaaaactccagtgcagcagggaggcagggggaggatgatggtgaagggaaaccatactctctgcattctttatagtgctatattctgcagtcaaaatagatttctttctacttaggacaaaaagagcaaatccaggagtataagataattttaaattgcctacatcgttatggtgctgatttagttacagcacttaattgttgaggaaagtaaggcaactctgaataaaagcaaaacatatggaattaataataaatagctgtatttgtttatttaaagtgagaaagcacataacttctttaaaattttatattgccttttaccctcaaaacaattgtgtaaagggaattctaatatctgatattctaatatggcttctttcagcactcccggaaatctttcttgttgcctgcgcgtcttgctgattccctagtcaggatcaccaatgattaattgtgctctgtttttgagtatctccctctgtaaatatattaaactctccgccacctagaaaaagaatattctatttacatgagatgacatgaccacaatgtcaaagagtaagcattagtctgaattactaatgaaaagaaattcttcactcagaacgcttatgtaaatactaccttaattgagagtgttgaatgctcaatatttatacacatttcatatttacatctttgagtagcatattgaaatgtaaaggtattggttttgaaactttcacttaataaatcattaacaatgaatcaaaagccaggaagttctatggcaatgccactgtagaatgggcctaccttcaaaaataagcttccaggaaaaatttaatccacacattattctaaacatatttgcagatgctatcctaaaattttagaaattcagacagtttacctttaagaagaaagcttcataacaacaatgtgacatgcaccatttcaaatggcaatggtaaacatttcattaactttaaaacattgtttacaggaatattaagactatttaatttttaaaaatgttatctattcataaatatgtgatgatcagccttgccatttgccagtgcagtagctaaaggagtgtgtgtgtgtgtgtgtgtgtgtgtgtgtgtgtgtttagaaatatatttcaaaatattctataattcagattattaaaaatacatatatatttttctaaatttggggactgttttcctatttttctgtctaaaatgttttaaatgtgtaaatacagcttccatctctgttaatacagctttaatacatttttatatattcagataataatacatacaagtgaagactgctcttgtcctccactattggttctgtccccttccattgtgacagaattttagtggggcacatggctgctcagaaaaaggctccacttctttgacactttttgagttagatgtgactaagttctaaccactggaatgtgagcaaaatgtcttactcttaaatgactggatatcttctctccaaatctctttccctttacatgacagctgggaaagaagagcaactggaagaatcattttgcacccaggcatggaagccccatgctaaggatggcagagtcaccctgccagtcctagatggcttacctctcaactgctatgtggcagaaaaatacatgtttagcttgtatctttgtcatactggcccagcctgtaccccagcttatacaatgtcaccaagtaatatgacaaatgaatgacatttgttgagttctcactatatgtcaataaatattttatacagattgtatcgttaatcccaacaactccatgagattaaataacttggccagatcctaaagctggcaattggcagaaccaaggtataatagccttagggatttttcagagggatatgctataatactccatttaaagtattatgggttttcttcagttagaagaccatgaagaaaaaaatcagtgaaaacttactttctgtaccattgttagcaattatttcaatggaaatacaaacaaaccatttctgtgctatcaacagaaatgggaggttttaaattatgcatgtatattatatgttgacatttccttacactcttttctttttgaaaaaaaaaatcaaatggaaatattcaagagtagatcattgttagtggcagagctttggcttcttctaatttatatcttttataaaaagagcattagcataatctgatatactcaccttgtttatgtggggatttgcttatgttttcaaggtacaaataaggataaaaaatgctattaacatatgttctaaagcatacaagaaggtgtttcaaatttcagagttgcatccaatttaatagttgtgtaacttagaacaaaattttaaccttctctcaattattttacccatcttgtggatgagcatatacaactgatggacatatgtattctccaaatggttcagtaatggaataatccaataagagacatcttaaaagtctaatgcatcagggacaatagtcctaaacaaacctattcactcttgatctttaacagaagacaggcaggtaacctgggaaaaatctcacatttgtaaagttgaagcactgaatgtatttaataatattagcaactttccatgggctactattttaggatacaataaagcaattttcactaaattgcaaaaatatattactattttattttattttatttttgagacagggtctcactctgaagcccaggccgcagtgcagtggcatgatcaccaaaaatatattactttagctgtggtgcctgtgttggttcttggccttcatgtaaaaagctaattgtaccctgtgaatccaataaaaatgaatgtaatttgtaatttgaagaaccttcatttctacaataataaatttctaactggagccctgctaagctcctgtatttattcaacttctggtcctcaccatatatccaacacccccaatctcagctcaaagttcactctaaactctgacatccttcagcaaaaggaatgaggcaatacggaatcatctgtctgtgtaagatgacactctttgtgtgccctagtacttaaattctatttccaataatgaattctgctctaatactcctcccaccaccccagttacctaacacattattcattaatttggaatttttctgtgaccgtaatgaggtatgtatcccataaacagaaaattagagattttctttcatcttttccattctattttgttatgttaattcagtcattgattaattcatcaatatctatactcttcttagtaatctatccttcataaagcataatagaaaccaggtgaaaattctttttggttaatgattcattgcaaaaaagcagattcagaaaaaaaaagtttcacatattaacaccaaaaggaacaatgaggccagccaagcaagttgttttttaaggctggggaagcactcacagagtaagggagatgctcccaagagcagcttatttttaatctccatctgtcgataaagacagtcatataacttctcaccagaacctgtactttcttttttttctcattatgattaaataaaatctttgctctcaatttaaatagtatctaaatgaaaattaacaaagaagatttggtggtacttccataaactccatgactttcatagaggctcacttactacctacacactttcatattctaatatagtttcccacagtgaatcattgcagatcccaagcatcggcacacaataactttcaagtttctttgcactagtaatcgagattttttttttatcaacagagtgtcagttctctgaggagaggaatactgtttctttgtttatccttggcagcctgcacagtgtctgggacatattacgtgctcaacataatacactgactagaattaaatctgatcattgttattcgcagggaacacctttcatttccaaacgtattccttatctcacagacacttaggtttgttcaacactctctacagttgttttataaagagattctggtataattttttgaagtttgtgtgtatttggtttccttaagaatttctattaatacataaagtaaccacacattccagtttctcatatatatttacatgataaaaagtcatgctatatatgaagctgcttttataccactttatctcattgactcatcacatttttggaaaataaaaggcctcattgcatcactaacaacacaaaatgagaatattttcaaatgtattatttacattgaaacgaaagtagtggggcccttaaaaagtgacatttaatttttaataaatcttacagaacctatacatgtaaatgctcttacccatggaaaataatctagttaagatgccatacaaatatttatattgctgtcactcaaaaatcactttagagtgactttcatagctaattcataagtcacaagaaaaatcgtcttttatagagtctccttatcttgcaccagaaccgttattactgatctcagtgactatctctaatctctagacatgcctgtaaacacttttcaaataatttttaccctaatagaatgaatatatgttttcactgaggatattcaaaagaatccatcacaggagttcaagtcaccactgtatgagggattattaaatatattctgaagaatggaaacattataatagtaagtacatgacttccctatttaaatttacggagagtatacataacacgcagactcacttaagtgagacctacgtatcaactgcaaagtgtgctgagaaagtttccttaatttctaaggatggcatttcctgttcacagtaactagcagtaccaatggtttctctcagaatttcaccaccagatccacatgagaaatcatatcccatttgtaatatagagacacagtttcctagaagatagaactgcattcgaattaatgaaaagattaagaaatctctttggtggattttactcacatcaacaagctgattgactccacttgctgtttttgccagtgtgacaaggtcttcttgcatcttatccacccatgatttgatactgcagaaatcagaaaagattatgttctatcagatctctggcaaataaaagtcacatgctgatattttatatccacgctacagataattcattaaaatgcccttaaattattcctctccctcctagcaccgactatgtccacccttccactccagctttaaattgcaaaagcactgaatccttagtgtgcaggctttcaggatgctgaaatgcctccaaatcaaaggagaaaaatgacattgatgtcttgtccaaggagagtaaacaatttgcttattttgaattaaaattccattaaatagctattaaacattctaaactacaaactttatcttttagcttacaagtcttctgaatataatagtaagatcatactaaatgcagaccatttgtaaaatgcaagaataattccaccagccaggtggaacattcaacaatttgatgcattcccttctagtgttttaaaattcattcacatagttgaaagtatgttatataaaatgcatatctcttttagctttataacatatgatacatactttcccatgacgttacattttgtaaacattttatttttaatggccacttaatattccattatctctatattccataatatacttgattatcctcctttttaaagagaaatttaagatatcatcagcttttaaccactacatactacaccaccacaaatatcttagagcctgaagcttaagaatattttatttccgggccagacacggtggctcacacctgtaatcccagcactttgggaggccgaggcaggtggatcacgaggtcaggagattgacaccatcctggctaacacggtgaaaccccgtctctactaaaaatacaaaaaactagccaggcttggtggcggacgcctgtagtcccagctactcaggaggctgagacaggagaatggcgtgaacccaagaggcggagcttgcagtgagctgagatcgcgccactgcactccagctcgggcgacagagtgagactccgtctcaaaaaaacaaaaacaaaacaacaacaacaaaaaaattatttccttagctagactcttagatttggaattactagatccatttatatttggaattactgaatttggaattactagatccaaataattactggaattactggatccaaattttaaagcaatagttttgatcattacaattatgatcgaaggattgatctttttcaggtatgcaatggacatcttaaaatataagctatggatgtcaggatattttagaagaccctaaatccatgttctatctcactttttcctggtatgagagatattaccaaatagaaccacacaaacttccccattcatattaaaatcatttaacttgtattcctccatatatttcacttattcttcctcaggttgtagacctaaagcatgtattcctttttgccaaggcaattgtaaagaaacattagtaagccagtaagaatgctagatgatttatatttgaatttgaacttttctctacatatctatatataatttcaataatggagatttaactgtgtatgtcttctcttccttagggaagaattccagtagtataaatataaattttttaaaatataaatgtaagtagtataaatatatattttttcagataaatttaaatataacaaaatatggaataaaaatataacatggaagagatttaaatgacatgtaagagagcatttaaaagaatgatgagctgataagagaaagaaaaaaatggaaagccagttataaaaaaggatgaaatgccttagaggaaaacacagaggcttgacttacatatgaaacaaactagttactaaatggaatacattaaaactaggaatactttagcacatatgaaaataaggaagaatacttattgaaccacgctgtatgaacaggatagaaaaaggtaaatgaatatcaagaaacaaaaacaaataaaagggaataatgtataaaatagagaaaaattgttataataacattttaactagtgctacttattagctggtgcctatatttgaaaaatattataagtaaatattcttagtaaacatagttgtgccccatttttatattaaatacaaaaaattatagtagggtacaggtaggagcaaaaaccattgatccagtaatttcctaatttagatgagactatctcatttctctaagcaggtgctgaacaagtcctagaacctacaaaaaatgagtcatctcttctcaaatataatttccaacactgacaaataataagacacgttatacatccctttagctcgaaactgagaggcaaagaatatatatgtaaagaagtgaacttaactcatccctgaattctgatttatactaaactgacccaaaacatgtattctaacttgacacaagtgcactgtcacttccagtgttcatttaggtgagcctgttttggctgaaaagcaattcagaacccatccagtcttccctaccccactgacaagctgttaggaacactttataggagcaaggattattttttataaatatgaggtgttaacttggttttctgaaatacttaggcactctgcctttcaacctggaattaaaaggttataaaaaatagaaaataaggaaaggtcccattcatcatgaaagtaaaaaattactcaagggaaaacactcatatgagcaaaaattttttatcaatctttctctttcttggtaaactgtcaagcacaaatatgtaatcgctaagcactgttttattaaatttatccagaagacactataaaatttgggggaaattacagaggatacagctttttcacataataagaaactaacatagcactccattaggaagaattcattgttgttctttgttaatccattcaacaagtactagtaactgctggaaaagacactaaaagatggagatgcaggctgggtttaaaaatgggtctgggaggaagagagaaaacaacaacaagaatatgataggaaatgtttgaggaagcagaagagagccaatgcttagtaagtagtggtatgagacggttgatagaagaggctttctggagtagcagctacttgaagtcatatttgaaagacaagtggaacttgacaaaattgagcagagagggaagtaacaatgaaggcaaagagaatgtaagacatgatgtgttcagtaacttcaagagattcaaatgactgagtccaagcttggttcagcaaaaggtatggaatgagggcaggagtgatagggaagagtgataggccaggccaagggtcttaaatacgattctgaaacatttaggttatattctcaaaataacggagagatattagaaaatgagaagtcagagagtaaaaagatcatgtaaatgtatgtaaacatgattaaataatttccctgacactgaatggatggtagcttaaagggagaacagaaatcacaaagacaaagtctagttaagaggtaagaaatgagatggactcagactaattcagtggtggtgaaagggataaagggaaaagaaggggaggccaagtacaaggaactagctcaacagaaattctgaaggatggacagtaagacttcatgcactgttggatatagaaagtgaaggagaggaagaatatgggatgattagggagtttctcaggtagaggatgatgggaaattgtggtatagaaagtaagtataggagaaataacagtttaaagggacattgacaggttcatttttattggttcgattagaggtgtttgggggaggctcaagtataaatatacactaggcaattgaatggcatgggtttaaagctcttgaaagagaaatctccatagaaattaaagatcaatgtataactcccaaaggagagtgtacagcgaaaggaaggaaataaacagtagtgacaactctggaaaggtacatttaaagaacaaatagaggaacctgagtagtaactagaaaaaggaatccaagaacaatggtatcacaaaagccaaagaagggagaagtttccaaagagaataaagaagtatacagtcatcaaataaggtgagaaatttatccaccttatctttgaggagaatgatacatggagaatgaggaatcagtgctccttttggtttttaatagaagtgagcctatttctatgcaaaaagagaaaggcaagtagagaaggaaatatcaaagattcaggagagaacatgtaatttattgacaatgatggggtacaggaaatgccacccccaaatagggcaccttggcatttaagaaaacagcaaaagcaggaaggtctttctgaccttctcccaccaagcagacaataaagcctaggaagatcactgtctgaccttctccctcccttcttcgctgaagactctcatgtggcgagtgtcctgccctataccaaagggaaggaacatcacacagagagtccaagaagtactgaataaacaagtagatcataccctttcatcttccagtcatacttctgcaatactgtccataaaaacatatagttttccataggtctttgggtcattttctgaaggctcctgtgtcacataaaatttaattcacatgcttttctcttgttatctatcttttattttataggagatctcagctgtgaatcctgcaataggtaagaaatcttttctcccctacaacagtcctttaaaaggctccagatattttttctagtttacccctctattccaacatgagaatgtggaagtgggggatgaattaagaaataagtagaaccaaagagaaatctaatccatggctagaagagaggataattcttctctggaaaatggaaagagaatgcagatttgaggtaaatggaaataactggaataactagaacaaaagttgagacagttttacttactgctctctatttcctttgtaatgaaggaggaccagttatctgttaagggacaagaagtaggtattaaggcagacagttgaaaagaaaaatgggaggcttaaaaagaatagctggaaagtatttaaggacttggcactataccggaggtcatcagtttccaccggtactagtcagtatggctatgtgaaattcttactagtactagtctgaagagagcaagttcagagaaaaaagacattcagatgaatgtggggcagataccagcaggtgaaaaagaaaaacaaggaaaggcaagttgaaagtcctgacaatttcaagatctccacacattctaaattaacaaggactactaaaatatttgctaaaatgttattatactgtattcataaacaaggcttatctctttatatctttttctatggaaccaagaattttatcataatatttataagaaactgtgaaaataccatattaccagatttcaaatttttattttttgcattttttgcctgataacttatgaatatgctgcagagactaaatgaggagggctgagtatacacatcacactttaaatcacctgacacaggcatttttaaaagaacaaaatcctaaaatcattgtgaaatcaaattgctctaagaaagtttaatagtttgaaaatctttctcttagaaataaatatatacaatctttggccagctcaagaaagtgcatggcaactcatgtatatctggttgtacaggtataatagaccttgactaataggtacattgtttccatgagaaaatacacagaatttttcaaatatgcagtggcaagaacacacttaacactgcttgttagaaatgtatattccctgacttcaagtctccaacagtaacagaagtttcagtgttataaagacaggacttaaacatgatagctagtcagaagagtaagaacaatggatggtacttgtgaaagaaaacgatgagaagctccagagtttccgtatgcagtcaaggtacatatgcaacaggactatgtcttatccttttcctaactagtgttcatcactgctccactgccctcttgagacccgtgctcctatggctcctatgaccatattccctggtctctcttcttttatattattatcatctgactccttttcattttcccaaagccaaatatagtcatttctcagcatctgtctttgattttacctgccattctccttccttacttctctttttctactccttctccatatataatctccatatataatctccatatataatctctaaatctgagctccagttctatcttaactaccatttgatcatttcatccagatgtcctaccattcctttcaaatatgtataaaattgaactcaatatcttcccccctccccatactataaaccctctatgtcccttctcgttgttggaaaatcatctccccagtcatcagggtccataccatcttatccctcctccagtcctttgtttaatagtagtatctcagcatttttccaacacagagctaatagccaaatgcattgagaccttattttataccatctctatgctaaagtatttaatatgcattctctcatttagtcatcataaaaactagggttcgtctttcactgatgagaaaaactaagagatgaagaaaatttagaaaaggtaagcaacacagccccgctagctttttcctttcaaagactttttaatccaaccaacctcacacatttccatgcatgttgactgtccttttccacattctgcctttgctctgtatataacctctacctggaattaatctcccacttccatcgcgaatggataaatcacactaatattctaatatcacctttcacaacttcccaaactaaaaatattctcgtctctccactaaacttcaaaagtcctttaattgtgctgtgcgcttatttccttatactttcagaattagataaatatacatttattctcatttatcaatacatttccaaaatttttatgacagtgctttgaatatagcagacacataagtatttattgaatagaaaagtaaattgaaatgaaatgcaattgcactaccatttttttaaaaaaaatagctatctttatttaatgtttgaatgcgtatctctccgtaatccacatcagaaaaaaaaaatgaactgctggacccatgcatctgtaaatagcatccacttttcaacaagtagcagattatcaaaatttagacttgatactttaaagaaatgattaaacctctagagtgcatgccttaaaattccaaatattttgtgtgtattaattgtcatagaaaaaaagtcttataatccttctctgtcccttcaataactcattacagagttgactggcagtacaaggtttctaaatgtttggtgtctacaaattcaataaaatttgaagcagtcactaaaatatctcttaaaattgaggcaaatattttattgaataattgaaaaaaatcttttatatcctctacttcactttattgtacagaaacagcccaaattctaaaaataaacatatagaatatgcagattttcattaagcatgagagaaaaaacttgccattcaattaatattgttcctttcaaggttggatttgtctgtaatgtggctttcaaaagagtagtgcagtgtatagttcagtaaactctttattttcaaaacgaaaaaaatatggtaatccatttcattttgtgtgcatgtgcaaaacaacaaattcagaaaaacacaaattacactttgtgtaatctactgtaaaagtataacagttgagtacaaagtgtccagtgtgcatagttatctatttaattgttttaaatcctaagctaaagagagaatttgcctggttggaacaatgcagccaaaatgatagctaagaattgttataataggtcctatccaagattaaactgtctttccttcctatatttgatgtggataagtcctctggaaaaaataataatgtgtgtaaacagatttgtaagaaaagaatattgaaacagacctttttttccatgcccttcccaatttattccactagcaattgtcacagagacaaagagggaatgggaactataccacagagaaaatggaaaggaagagggcttgttgtggggtggggggtggggggagggatagcattaggagatatacctaacgctaaatgaccagttaatgggtgcagcacaccaacatggcacatgtatacgtatgtaacaaacctgcacattgtgcacatgtaccctaaaacttaaagtataataaaaaaaaaaaaaagagggcttgttacagtaagggatttataggagggatagtgggaaagtgagatgtctgtaccactcggagccctatcctaaggcagttctctgctttttgccactatttttaagaaatcgtttatttttaaccgaagcaaataagagacatagttatgccctgtggagctggggaaaaatttaaatatcaaaagatctaacaaactgaccacttcaattgtgttgatgcataaatagcttatcacaaatctgaagtaataagttcatatatttcaaaagtctagtgttccacttgctataaataccctaccaatgccaaactgttcctatttttgttatataataaaccatccacagtgttcctgtagttgggtaaaaataacacaagtaagccaaagatttagataacctagacatgaaatttcgctaaatatgcttttcttataacatggataagtatacaattaattgttttggtataaagggagtgcttgttatctacattaaatcgtaggattgtttgtgagatgggtgtcatgccagaaatgttagttagttcctgaaattattctcaatttaaaccattttcaataacactgctgctctgtttttagaaagctgtttcaacttgtgaagtgctttagtattccatttttgactagagtaatcctgtaagaaaggcagaaaaggatgtactcatgctaatcagtggaaaggtaaagtacttgagagtaggaaaaaagactatcactaaactctgattcctaagctgttcatgtttctctgccttcattttctgttttttttttctgctcgtgtgtgtgtgcgtgcatctgtgtgagtgtgcagttaatccacattacaaatttcatattcatagatctcaaaggccatgagatctacttttgttcataagatcttcttttcatgagatctaaatttattttcatgagatcttcttttccactatcttggattgatttttgttttatccaagtattttttttcatcttttctttattttcttcctcagctgcagcaatttgcttccagcttccaagacaacaaataaaaattatactttggggttgatagtaacatagttccatggattagctgggggagtgttctcatacatgagatttgttccctgaagccttgagggttttgttttttatccttccacatcacaattagttacaacctctagcatagtcccgggtagcctgatgccagccgaggtgtcccacgtggccacacaatctgctgctggtgtttctatgaaccaaatgagctaaaattctaattgctcattacaaaatctccattcattttattgaagatctttccctttatggtttatctgtgatttttctcagtcattgcaaattgttcgcaaaatttacttcagcctaattcgagcatgtatttaattattatttaattaccatgatattacttaatgtcatggtaaaaatttccttattttctttatttctatgaattattagctgatcattcataatatttccaatactataaaatcctccaatgcttactacttttggattctaacctaaatggtgaatctacttccccatatagatcagtatctccagtccagcgcactgaactgttttacaaatatgtcagctttgtcatgctctttaaatacgttttctttctactaaactgaaatcacctctcgaatcctcttcagctactgaaaatcacccaagtctgggcttcaggtccctcttctggccaattcaagtcctcaaactatcataattttttcttttctctgagtatctaaaatatgtacagcctgtcctacaaaatgttacacatacagacatactgttttatatcagtgttatttctccaacaatatttaatttccttgaatggatgggccatagcttatcatgttctgaaactatctagcacagttctgaacatacagtggctacttaaaaaacaacaggtaatatctattgagcacctatatgtcaggaactgttctaaacatgctttgtgaacatactctttaattctcacaaaaatctattgaggtagataccgttattagtcctactttacagatgaggaaactgaggcatagagcggttaagttacttaccaaaggacacaaaattagtaagtggcagagcagtttgccctgagaagccaagaatgtataactccattaataaatgctaactggtgccatgatctgattcatggtttggttttcattgttaaaccaccagatagtagccctcaactctcctctcatcagaacttggagatacctcttgttttctagtttatagactgtcatagccctaggttcaaagtctgtttcattgatagaaagaaaataacatttgcagaagtctttctttacatggcaagaaaaaaggctgttacagttagaaaatgaagatttaaaaacaagaatacctaagtaggttcttccttaagacatctcagtggaaatacatgcatattaataattacctaaatgctataatttttcctcacgttacatttttaagttttcatcagtattttcaaattaaacaagtaccatttattttacttacaaccagaagttgtactactttcattaacataacaagacatcctcagtgttatgcattaggtccacagcaattgattctgatattatttataacatgcaaacagacttgacatacaatagcaggttaggtggagagacagccctgatatgtttatgaacataaaatattctaaaagcaacattaagtccttcaatatgcatagaaaatatgactatttcagctggccttcattgtttttatgatgcaggttcagatatacaaacaaatgtatgaatataaaaccaggacccaaattgactcatgtggcacttcttttaaatatagcccatagtgtaatttgctgacagctcttctaagacagggtttatttaacaatcaaaaagctgtcaaagcaaatatattaacttgcaaattagaaagacaataactctctttctgaaaaccatcagaaaagaatattgccaagttagtccatcttcaacttttttatttttttaacattaagtaaatgattctagagaaacaggaatgaagccttcaaatatgagatggtaaacatctttctagctcagaaaatatattgcaatttaattgctttcaacctttttgtcctcacagaacacggttctctttgaccctctttgcctgagcagcatatacattgcccttatgttcccctctgctggtctgagcacagtgaacattctaaacagaagattgtttcttagataggaattacagccagctccctttcctaacctgctcaatataaatgaaaacctaaactacgttttttaccaaactgtttttcaccattaatgcagtaaaaataacaatgagaattgtgtttaaaaataatgtttatcaaatggcaaaaaagttacaattttgagcactatccaataacccctttcagaaactgtgaaccattagtgcaaagtttatataaatgtccaagtaatacagaaaaagaagtcatttttaatttcttggtcatgttttcaactattttttaatttgaattgttaaatgtttcaaattatgaaacatttgctaatgtttaaaaaaattatataattgcgatctttaatgtattatatgttgaaaagcaggtcaaaatctaggcaattaaattttttaaaatattaaaatattaggcagaaaaagcactttgtataactaaatccaatagaagcttgcatatcatacgctcagtagattaaaaacatgctttaagacatgactaatgtacgtacagttattggagaaggcttttttaaacatttttctagttaaatatttagtatcatataatttgctaatactaacaaaagagaaaaatcacagttttagctatattctctcttatggggtagcaaatgtcaagatggttactggaatttaaattattaacataaaatgtgaaataaacactttaaaacacaatagttgatctcatgaaaagcctcatttgtgttgatgtttatatctttcatatttcaaataattattccataattagaagcaaagacttgaaaactgaatcatattcaatcatctcagatacaggtaggaagcatttaacaagctccggtgaaaagagaatggtattttagcttgaggtccctgcttaagatggcacgcccatgtaactcaccatctttatgaaatataaaagaatcatgaagcagccagtaacatgaattaaacatcaacattccaaatgaattgttgcagtctcccaatttttttgtcattattagtcattctgttactgttcctagtgctccatttagagcacatcccaacgtagatttcaacaagcagttttaaaatggaccaccctgtattgtaacgttaaagtctaaagatttctgaggctagatctgtgaatcatatgtgattcagcagcctcccacaggcctgacaacccttatattctctctcaaaatgttccttctgtagaagagaggctgaatggactcctttatcaccattcaggaaatacaaaaggacttgagcacatgcaatccattagaattcacactacctgttttaggtcacctgcagtaatggaggaaaaaaggcccttcagtgcatctcctgctgtctgcagaactgtcttttcaactaccctacatgtattttcccaaagctctggtttatcctctcatgtctcttgatcatatcagggaaatagtggcctcatactcatttgtatcaccgttggacatcttgtaagcgaaccttgaactgagattatttctccaattactgcaagtaataaataatattttcaaatacttccagaaactgcagaagaaaacatcatggtcttttagtccagttcttaataaatggaagcctcctttatacattacacatgaaaaattatcatggtaattctctcaaatacttcctgcaatgggcattcattaccctactaaaaacctttttatttaggcacaaactgtcagaaagttctgctaggtgcaaaagaaatgatggtataattgtcgtatgaattgtcaggcaaccccctgaaataagacctattctttacatacacttctacattgcttaatttttcaatgattattatcactttgaaatgcctaagttataaaaatttcagaaaagaaattaagtgtcctcaggcatccaatttctaatgcctaccaaaagaacacataaaatagtctcttataatttatgcagctgacttagttatatatggtcatctgactaccatagttttatttatttgtctctttttttttttttttttttttttttttttgagacggagtctcactctgtcacccagctggagtgcagtggcgccatctctgctcactgcaagctccacctcccaggttcatgctattctcctgcctcagcctccccagtagctgggactacaggcacctgccaccacttccggctaattttttgtagtttttagtagaaatggggtttcaccgtgttagccaggatggtcttgatctcctgacctcttgatccaccagcctcggcctcccaaagtgctgggattataggcgtgagccaccacgccccgcctgtttgtctttatccttagatttaactagaatgaaaggagtgaataaaagtacatgcatgcaaagggcaaggtgagactttttatcttgaccttattaaaagaaaagcaaatcagcaactaagggcgaaataagtagtaatgataataaacatcttacatatgttttggataaatactttctgaccaggtggtgttcaggcagcactagacatactaaattctaggacctaggcttggagttaatggatggactgggtctgattctccagccgggttcttcagactatagatctaaggagaatcaatagccagtgtccaaggacaaagctgaagccaagaaccaaacaagtagcccaaaggaatatgattcaaaaaggttgggtgaaggcagggcccgggggctcacacctgtaatcccagcactttgggaggccgaggtggacagattgcttgaggccaggagttcaagaccagcctggccaacatggcaaaaccctgtctctacgaagaaaaaaaaatagctgggcatggtggcttatgccagctactcaggaggctgagacacaagaatcacttgaacccaggaggcagaggctgcagtgagcagagatcatgtcattgcactccagcctgggtgatagagacctgtgtcaaaaagaaaaaaaaagtttggcagaaagattgcagggttctggctagggcactgcagctggagacaagaacatagcaaatgtcaaagatagagcaaatcaattgagaactatggatctagctcaagaagttcatagcatgattaaggacctatttatagagtccctgcattgttgtccacctgtggatataaaggtaaaagccctgactggttaagagaaatggtcaaaaagttttgtttaaagacctccactctgtatgtagtttcttgccctgggataccaaactgcaccatgctaaatgccactaaaatgagaaattaatctggtttttcttatttctgtaataaaactgctatctaagaagtgcataatatgcttcttttatgttaatgccagggctcgaattagaatcttattcttgaccctcccaatcagattcttcctgctagatttttcaaaagcacatggaaatcaccttggataaattcaagcatagtgtatatactttccatccaaagaaaacttctctgtcaggactgtgcgaaaaggtttctaattgccatcccagctggtcttgttccctgtgttcagttttctgatgggacagaagggaaagtttatggaatgaatgggcagacaataggattaatgcaagagactctgttgtgttcatcgcaatgtctttcctcttcagtagagacattcagggagggcataaagctaggaaacccaggggaaataacacattcctgattgaccaattctccctcaatttataacacagccacctggcactagataagactaaaaaagggaaaataaaacaaggaattgaaagagattcagataacccaaaggaaaacagattgagagaaggcatgagggacaaggacatctggaagttgggagaagtggggaagacagtagaaaaaggagactagaaaggaacgcacattttagaaaaaggatgtggggtttcccttaaaaatgaaaatttacttttgcacattaaaaaaaattggccttccaccaaaaactgtaaacaatgcactatctaatgcactactgttcaaatattcattgcaacttttaaggtatacaattttcagttctctagactaaaatgacataacctttaacacatatatgatgaaacatatgattactttggtttattttacatggaactgtgaagacaattctcttataagactatttttattcagaagaaagtatttttgtttacattcaatttattctcaggaaaataatgttcattgattttcattactcaagaatacatcctttcattgtgagtaagggattcaaataacattgatttttgtggtgtagaccaatgacagatcaatgaatagatggtgttttgtttatagcagtcattgggttggctacatagagaaatgaagttcataattgtgcatctctacatttttagctacgcttttgagcctttccatgaaagacacattaattatttcatttatctaaatactgaagagctatacgttacttctaaatattaggtagtcatctttcacattgtcctgaagtgttataggtggctaattggagagatttgaagacagcctgaacttatattgcacaatttgcatgaccctcctagttattttctcctgaacacagttagatgacagacaagaatattgggtactcaagctactactgggaggaggtctttgttgttctctatcattctgacagggggcctctttactccctactctcttagccagtgaatggagaaacgttagcactgagagcctcaaaagggaaaaggaaccaaatggcaaataataccaaagccaactctcctcctagaccactcgttgctacagcacagatatataggcccatatactcactttcactttggggaacagaatgaaattttggtcttgaacttgtgtcatccgtagtatttgacaccgtcattgaaaagcagttccttttattctaatataatgtcaacttttgttctagatttggggagtatatatgcaggtttgttatatgcgtatattgtgtaatgctgaattcagtctagggtacaaatgatcccatcacccaggtagtgaacataatagccaataggcggtttttcactccttgaccccctctctatcccaactctagtaatctttgtctattatttcaatctttataaccatgtgcacccaatgttcacctcccacttatatcagtgaaaggatgtggtatttggacttctgttcctgcattaattctcttaggatactgacctccagttgcatccatgttgctgcaaaagacaattatgtgttcttttatatggctgtgaagtatttcatggcaggtatcacatttctctatccaatccactgttgatgggcacctaggttgattccatgtctttgctattgtgaatagcactgcaatgaacatacgagtgtatttgtctctttggcagaatgatttattttcctttgggtatatatatccagtaatgggatggctgggttgaatggtagttctgttttaagttctttgagaaatctccaaactgctttccacaggggcaattatggaactaattaccattcccaccaataatgtataagtggcccctttcctccacagccctgccagcatccactggttttgacctttttttttttttttttttttttgacggtgccttgctctgtcaccgaggctggagtgcagtggcatgaaaagggcttactgcagcctcgaccttctgggctcaaacaattctcctgcctcagcctcccaagtagctgggactacagatatgtaccaccatgccaggctatttgttttttaattttttgtagtgacagggcctcaccatgttgcccaggctggtctcaaactcctgggctcaagcaatctttccacctcagcctcccaaaggggtaggattacagcatgagccaccatgcctggctgatttttgactttttaaatatccattctgactgccgtgagatggtatctcattgtggttttgatttgcatttctctgatgattagtgatgtggagggttttttgtatgcttggtggctagaaaagctattcctaacagtgtctgctcttttttctacctaccatgctttctctccatgcctttgtatcttgtctcattcctttaagcaccaggtcaaatgtcaccacctcacagaggaattctcaaccatactacataaattcatcacttttccctgctttctgtccttcacatcaggttcctattgtttcttcagacactcacaaccatgcaattattatatttgtctatttacttgttttcagcctcttttctccagaatgtaaacagcccaagagaaagtgtttttcaccagaagtcaaaagcacttatctttgcactgagataaaatagttgcctagataaatattaaatgaataaaaaaaagatgactctttgaggcaagcaagcagagtagtcaaattggtatattagcaaggcgtgatgaacaaggtttctactggaaaagcatggactttttaatccaataatttctctttttttcttaactagtagaatggagaggatatgggtaaaaataatcttagctgacacagagaccataaagtttcttttaaagttatgtgcaaaaaatttttctatttgcaatatctgaatttgtatataaaatgtccacaaaactgtttcatatggagtcagaaaaaaaaaataaaaggatcactgtttcctcataaaatttcaaaattcaagaagggtgaagccatcgcattagcaacctcaatgtaatcaagagtaatgatctctgggctctgtcccccgacaccagctttgatccagcaacatacttaaaagaggcactgccaccactgccagtttgctcagctacctacatcttcaactgccagcatctgctttggttatgggaatgctcctcgtagcaagcagaaacttcaacccaaaggattgtagaagtatttccctatgaaattcaagtattggcactagaataaatgtttagattcttcagagaaaagcagccaaacaaattgtgtggaaatatgcagagggtactatttaacattatatggctttgccaattgctaaaattacttttaaaagctcattaagttctgtgaagcaggaaaataatgacaccatagctgatctctcattcaaagtcataagtagattcctaaatggaaaggaaaatagagtatctgcatttttagactttaaacaaatccatgtactattttactttactttaaatttttgagactattagttccaagaaatgtattatttcacatcttttatgtatgttttaatctaacctcaatttcccagagttgctaagagactagaattctattattgaacaaaaaataaaagtaaattaaaataaattacagccataggaacttgttatttgtaatacctacagcctaacatattcctcctttttcagaaatttccagatacatcacagtcatagttatttacatttcaactattccataaggagtctccataaactaatcctcctacacttccaatgctttcttctatcaatattttttcttttgctatacataacaatgactcttgtatcattctcattccagaataacctaagttcatcttagatcattctgtataaaatgaagaagtttgaaatatttttaagtagagaatgttactaatcatatactttccatttttccaatttacagacacttcacttcctatttttttctgctgggaatgtctcttccttgaaagctcctttctagaaaatttccagtcatcttttaaggttaaatttaatagtttcttctctgtaaatccctttaggatgctataaaatttacatacaattatcaaaaagagttttgcatttcatagtaattatttatttatcaaactctccattaaactttaagcttcctgcagacagtgacagtgactaatgcttaatacatagtaggaattcattaagtgtttaatgaattaatgttaattctattacctgaataactgtctttgccacccccttctctttacattttacactgccactgcttgtagggactttttcatctagtatatggactactgcagtttccagctaactggtcaatctgatctggcttcctctgcctccagtacttcaacagttcttttttcagagtaaatattaatggatgatagtttgcagtagcatcaacattacttttctgaatgtaaaattaatgtgtatattcattacatcacaagaaattgtaagaagttattctactactaaaacaggccaagaaaaaagacagaaaataagctgatttcacctatgaccataagcaaaatcctatataaaatattgataagtcaaatcagacagacattttcaaaaatagtatatcatgaccaaggaatagttgttttaggaagatatagatatttcaccttagaatagcccagttcctccataaattaagagtgaacatcaacaatttaaataacttctctgagtctgcttttataggtttgagaaactgaaatcaattaaaacaaaaagaaaaccattcagagcaatgcctggaagatactaaataaacaactatgattaatattttattattttcaacttgtaatgtaatcctgtaaattaacagatgatggcaaaagcggcctaatcatttcaataaatgtcccccaaaatctttttattaatattccatttttattcttgctaaaatattagggtgttagaaagttctttaactttcacattatctaccatagagatatgtgaaaaaaatacttaatgttaaaatctttaaaatattccacttaaagacaaaaggaagaatgttcactctcaattagtccaataatgctattacagaactcatagttaatgtactaggacaagaaaataaatacaaggtaaaagctttgggaaagaaaagaacaaaaacttttattatgtagcaatatgactgtctacataacaatctaaataaaactgatgaattactaaattaaaccaaggttaagtatgaaattttggaaaatcaatataagaactgtaaagaaataagtggagcagtatacagagaactagaaattatcaggaaaaaatgattaaaattagtgataagaaactcagcctcattaataaccaattaaataattaaaatacacaaaaatattttattacaaatcagataaacaaaattttttaaatattgacaaaactggaagagataggtaaatggagggatggatggatggatggatggatggatggatagaaatagagatatacagatatagatacagaaatagatataagtagatacacatactctttgaaagcaaatcaggaaatattgttcaaatattttcaaagtgaaaaatacctattctcaatttatctctaggtttctatcacaagaaaatgctcaagagtgttcactgaaacagtatttgtaatagaaaacaaatggaagaaacccaaatattaccatctatgggaactccttaaacagtttatggtacattaattgcatgaaatacgcagtagttcaaatattgaattaaaaataaaggattttaaaataattaatgaaaagatcccaagaactttagtgaaaaagcaagtcataataacagacttatccaaatgtatatgtaaaaaaataaatatctgattctatatgcagtcacacaaggagcactgtaagcagtgaacactactgaaaagacacatgtgaactgttaataataaaacgggtagtgtaagcaggagatgggttataaggggtgtcctctctagtttattttgtatataacttattagctgcttgcatcttttgcaaaataatgcatagtaatgtaatgaaaatagaaatattaaaggctaattcacacctagtcacagaaagagtgtactaattaacatgatttagagtatttctcatttagtaaggttatagcaaagtgatgggtaaagttcatgcgctctgggctagacttgggttttaattctggtgtggctgtttatgagacgatgtgagacagttacatcatcattttaaaaattaggccagtaatggcacgtaattcacaaggtttttgtaaggattaaaaaaaatcttatatagaaaatgtttaaggcaatgtatggtacgtaataaatatttactaagtttctggggttgcactacaaagtctaaaatgctaagagttcgagcttaaggctgacaaataaaagtattgctaatctacagccctaattttattttattttattattattattattttgcaacagagcttctctcttgttgcccaggccagagtgcaatcgcacaatctcggctcactgtaacctcccggactcaagcgattcccctgccttagactcccgagtagctgggactataggcgcacaccaccatccccggctattttttgtgtttttagtagagatgggggtttcaccatgttgacgaggttggtctcgaactcctgacctcaggtgatctgcctgcaaagtgctgggattacagacgtgagccaccatgcccagccagctttaattcttttaagaaccaataattatttccattagaacagctgtgctcttgatataaaactctaccaaaaaatcatttattctagatgagactttaaaaaaacttttcactttaatgaaattctatgaaatgtttaacatgcaatttctttaaaagactataggcctagtatgttgtacaactgtttgtcattttcatgcttttaattcccttcagtattttttctatatttaataaacattctgttattagaaaaagaaaatgaaattaactaaacttcaatttcatatactgaacaaactaatataatttgaagcttaaaaactgtagattattggatttggatattatctttggtatgtatttttgtatgatacaaaaagcatgctcaactacaagcttaattaacttacatataaattctgttccaaggcaacatccccaaaattaaaaatatagcaaacaaaaatattagctcaaaaataagctataaacttcaaaatattgtgtggctttactgtagcgtttccaaaactaccaggtaattttaacataaatattcctccaaaaacctgttcaatcctctggaaataagtatgagattcctcagtgcatttaagatatgaaggaattcgttctctaataagtcacttacaaaactgagtagtacaaagaaagcagaaataaattcaatgaggcaaaatctaatattgtataaaattttgcagtatattgttatgaagcagatttttattttctaatcttacctaagacataaaagagaataattttattcaaatttagaatagggtttgcagagaaaaatcttgataattgcttataaaatcttcaattttcaaaatacatgatatcaccctgttttttgaaggacttgcaaagaatctacagcaatggatgattaagtattactatgtgtagaatcaagagaatggtttacagtttcctctaaatattcttatattttactatcttaaggttaaaatgattaataatatgaataaacacaatatcaggccaggtgtggtggctcatgcctataatcccagcactttgggaagccaaggcaggcggatcactggacgtcaggagttcgagaccagcctggccaacatggtgaaaccccatctctactaaaaatacaaaattacctgggcatggtggcacacgcctgtagtcccagctactcaggaggctgaggcacaagaatcgcttgaacccaggaggcaaaggttgcagtgaaccaagatcatgctactgcactccagccagggtgacagagtgagacactgtctcaaaaaaaaaattgagtattgaacacattttagaattatcaggttctacctagactgcctttatccatttaactcatttagtgttggaaagaatcttctaattgaggttactaaaatcaaaaattctttattgtttttctaataacatagtaatatgtttctcatcctttaagaaaaaccacacggtccacaaaaacactccacacacttatagacttgttgattaaactagctcccgtctgttcctcaagcaagcctcaacctttataattcatttttaagaacttaattttctgtgctgtcaattccccctttttaattgttacaggatctcatacataatgcacaattgtattaaaacacatcgtactgccttgtgacatagcataagttgtcaagtaaaatgtaataatctttgacctccacccacccattgacttcaataaaaaataaaaattatgcctacaatctggctaaaagggcttttagactgtggcaccagtaactccctagctaatgtacagaacactgagctccttagacactctccattctgttacaaatattttcctattgtgttttcaagggttgaatgtataaatagttatttacagaataaatctatgcattagtgtatctccaaataagttcagtgtgatcatacattttaaaacaaaaatatgcaattggtgtttcacttgcttctatctagacaagtgtacgaaaaaagtaaatcatagtttcaaacaatacaatcagggcagtattttctaaagaaaaccatcctgaaaatggaaggctatttaacaaaagttgtgtcacccatgggaaggcttccttctgttgccagctaaaggttgacatgggtcagtccgcacgaaaccagacatgaacaacattcaaggcaaaccagttccaatatagcttacttgccagggaacattacacttcctctccaagacagtgtaaatgttttaaggtcagaagaacacaatgcctgtcaaagtgtttcatgtatgttaaaaagacaggtaatttaggaagagtctctgacatttaaaagggagtcatgctttcaccatctccccctcctccaacttgacacctaattaagcatcaatacaaaacaatataattgaccagatgtactagtcattaacaggaatcacccattctcctatcaaatcagagcgtacagacacggctctatttgtaataggttgacttaattgcctgagaattccccagagaaatgtacaaatggatcaagacatctcacacatccacacgcacacaccccacagacaaacacatgcgctcctcctaagctttgatccatgcttttgtcactgtttcatccatctttgcaaatgagaatttatggtggccacaatcagtactagaagatcaattaaataaatggaaaaataaataaagccgaatgaaaggtaccagcattcagatttagcaacaccttaataataaaagctttttatacagcagtgctttgcacaatgtagttgcttaaattttgttggtaaaaacaaagcacatacctgctttgaaaatttaaaaaaagaacacactaaacaaacaaaaatgccccccaaaaaaagaaaaaagactacaaaagaattctttcccctggcaacacccctcttggatatgtagattgtatctgctgactacgtggctcagttttcccttattaaaacctatctcaataaaatcattttgaaagtagaaaataagggatctctctaaaggattaagtacgtagctggatttagaattcagaaaacagattccagttttctaatccccaacaagctaagggcactaatgcgaaggaatataagagatttactcccaaaaatatcatattggatctgaatttcaaatgaaaaattggcactccctcctggagtcagagagatagaagaaaaaatgagcagaaacaatacagaaacacaactttcaaacagaatgtcccaccctcacatgcccccaccaacatacacacgcatgcacacacactgaaacactgaggtctttcacttttctatctgtcttaccccatcaccctcaggccagtggagaatgcagtcactggtggctgcttgcatttcaggttctagagatgacattgtcatggcttattcctgggctttttccagtgccatagatttcccagccacatcaccaaatccctcctgttagaactgcaggtgccaagatcaaatttccagccaccctgatcacaagagtatgggggtgtagaaatggggagtgtgtgtccagttctaacctcttctcatacaaaatgttcccagttggttaccccagccccatggcgcctcttttctcctattttcttggagtacgtattatctacaccactcattggtccacttaatcaggcactgctttcaacacttcttacaattctgtatttttttattacaaagttaacgagctttctgtgtgtattttctcctccataaagaagtagatttttgagggcaaggcacgacctgtatttctttgtatttagcacagtgcttagtaaatatattcaatgccccccaaatattattgatttcattgtagactgtcttaattgcccacagccccaaacagcatgtctttgaggtctctagggtgaaaatcagttactggtgattgcctcgggctctcctgactccaggaggaagcttaatgactgaaaacacattggctgtccatcagtaaaacaagaccacgtgtcactgtgtttctgtgtcatctaaagctgggggatagaaaataggtgttccaaagggcatcttcagggccttaagccccctacctcttgttaaatatgagaagtctgtgcttcttttctcaaaaacatacacaaaaaaaaatctgcctggtgtccaattcatcagcctgggagatgggtaagaaatgtagttagatcccaaacatggctaaatcctttaaaaacaaatttttaaattactaggagcttttaatggatatttatccgtcttgccatatgactaagcagatgaacaaatacctatcactcacacactagaaatgaaacaagatttaatgcacacagcaccaatcatacatttcactctattgttatcaaaattacaaaacagctgggaacctgacaatgacaacctaacactcatgattttagatattgtccttgctttacttcccaaataggaggctaatattctctttaaagggaaacaaccatgagataaaatataacctttgaatatgaactgtgtatttttctcacagtaagtaaacaatagatattccaaaacagcaggcatcttattaattcagtagggtcagcaatgattaaactcttctcatctgaaaggaacagttgcacacttcttttccgaatatacatctctgtatataacttttaaaaattcatgtgggttagaagcctggatctgtgtatgtatagaatttccatatagtaccaagcttgattaaattttcccttgctactagccttctcagagactagcaaataaaatatttggctgtgaacagcatttcagctcaccgttgatgaaagtgagctgtactgagcaatgtcagctttatacttttaagaaaatcttttaggcgatggaggaaaacagaaacaaaaccaacactactttagaataaaatgctgaacaatgaaatggagggttattaattctctgccacttgaagattgttttccacccttcagcatgctgagataattatatacacatgacactgtataatacatgctgtttgcctacttcaaaactgttctctaatgcaaggattattgatagaagcttcttgtgcatcatgttaaaggcacaaaaaattacctaatttccactagagctaatccattattcaaattttgtcaggaaaatctggatgaattgtgtaaaactgccaggttccattcctaataaaaattgattcatttttattggggtcatacagtcagcttttaaaatctaacatctcttcttttgccaaaaaacctaacattccagttattgattaaagcttcagagttgctttggaaggtattagattttcttttctatttagatcagaattgttatattggatcaatgcaattgtaaccatctgtaggattcaactctccatgctggcatgtcttgtcccctattttattttcagagctagtatagccactataacttttagtaattctaacaagaatgcaggcagaaaaatctaataaaaattatgagaggaattattttggctttttctccctaaattgaaatatttgcctccttctttctgggtcaaggtatactccctcaccttcccctgcataatggaaggatttgatcatcttactccttgacacttgaaatattgattggcccatgaatactaataatcaagagtcactgtgattagaggttaggaaccctttaaaggacagatctttttcttgcactttctgccccttgccacatgatcataaggcctcgactgaaacgttcccaatctctttctcttcctggtccaaagaatttgcatagagaggaaagcccaagtccccttgtgaacctagctttttctttctacggttgatgttaaaaacaaaacaaattcctaaaggtcatctaagtcaaaccttcatccaaaggatgtagtctaaatatactacattttggctttatcttctcacttgggagttcaggtctccagagtcagaactgggattcctatcatgtatggcctgtatgatcctgggcaggatgctttgtctccttaaatttgtattttctttcctgtaaaatatagctacttagcattacctttctcttaggaatgctgtgagaagtaaataaaataatggattaaatgggtttaagaatattaaggctgggtgtggtggcgcatgcttgtaattccagcactttgggaggacaaggcaagaggactgcttgagcccaggaattcaagaccatcctgggcaacattgtgagacctgtctctacaaaaaaatgtttttaattagctgggcgtggtggcatgtgcctgtagtcccagctactaagaaggctgaggcaggaggatcattggagcccaggaagtccagattgcagtgaaccgtgttagtgccactgcacttcagcctgggtggcagagcaagaccctatctctgaaaataaataaataaataaatttaaaaaatatttactatagaagtgctcaatagcagttattgtaactatattcaacattatgagtgattatgagctcagtttcttaaaaattatattttgttattgttttttaacgatagaatttcttttgaaccatactgtctccctataatttttgtgcattacagctatctctacatttctgatgctttcattatatgcctaattttgtcatgaattctccagacttgttaaaaacaccaaattattagttactcttcctagactgtgatttcttaatacattagcatcctagttatctccttaaaaataacctaacttgccaataaatttgttaaatagaatttgactctgagacctgaagccaccattgaagatgtcctctggccagaatgaagttctgtatttgtcaggatggcaatttcatattcatattcaatttcacttcctaggttttaagttatattgttctttctgctgctgctgttgctactgtatgtgtgcaggggttgactcgtgtgtgtgtgtgtgtgtgtgtgtgtgtgtgtgtgtgtgtgtgtgtgtgttatactcgggagctgcatctaagccagttctcctcaactctgtattatagattttaaatttaatgtaaaattatatctgtctctgttaaattgtgttttttaaacaggggtgagagaggggactgggagaagaagtggtgccttttcatgtgtgtggcctatagtagttctttaattcagtttctcaaatgtttccccaaccattagcattatagttcatttgtaagctttaaaaattacagattgtctgatgcaactccatatctactgactgacgaatttcaaagcatagatcacaagaatccatggaaacataattcataatttttttcacctaaagtttttaagcccttctccctagaaaaatgtttcaaagacaatcttgataaatcatagaagcatctaaatattttttaccatttaaaatttgagaaatattttaacaaatacaaacatatttcttcattatcacttgtaacaatttatgaactatttgttttagaaaaaatgattatttttatctaacttaaacttatctgaacttctctgaaaaggacatttaggaaaacgtggtctgtgtgtctatacttgttgtcctgggatgcattcaaagattactgactactcagacaattgtctaaaatttcaaaattaatacatatcttgaaccactcactaactttttaaaaacacaaagttctgttgatatgttttgttttaactatggtaagaactggaaataatttgttttcacctctgtttcttgactctttcactgtaaagagtgccaactcattccttctatgaaatctatgggaattatctcatgtgtactattgtcctctcttcctatatatatccatctttctttctcttacccttcctccaatctttgttataatttatttttaatttttacactattttccattaaaaataagtaacatcttaatattggactatccataggctttaggcaatattttttactccctaagtatgaaaagtaaaataaattagtgccttgccacatcccttcatcatcccataacccaccttctctccactatagcattacttttaaattgtcaagtttattacatttacattctattttcaaactataattgtctcctatcacagtatccatgaagcagaaagttttggcattaaagcatggttcatttcaaatctcaaattttctcacctccaaagaagatgataaaattaaagtaggaaaattagttttgtgatcaactggaaaggtagaaaacatccaaaacatgtacaacaactcaagcctgtgctttcatgtaattcataatatcaactttatgtcaatacttcctttataccagagtctagacatagaggaaaaaatcctatgattgataggtaaaaatatcctatgattaagttttatatgtttggagaattgatcattcaatttttgatgtgagtgattccaaactattatataataaaaagtctgctctaactctagacattctgctagaacatatttttatagagacaggcggcaagtgagagggaagggcctccattcaataagcattttgactaatttcacaaaattatatattttgtgaaatatataattaaaatttatataattaaaatttcacaaaattataaattttcacaaaactttataacctcccaactactcatttactgtgtatgtgtatgtgtgtgtttgttttgagacagagtcttgctctgtcacccacactggtgtgcggtggcatgatctcggctcactgcgacctccgcctgccaggttcaagcgattttcatgcctcagcctaccgagtagctgggaccacaggcgcatgccaccacacccggctaatttttttatttttagtcaagacgaggttacaccatgttggccaggctgatcttgaacttttggtctcaagtgatctgcctgccttggcctcccaaagtgctgggactacaggcatgagccactgcgcccggccacatttattattaatgtgtataaatatgtccttgacggccgggtgtggtggctcacgcctgtaatcccagcactctgggaggccgaggtgggcggatcacgaggtcaggagatcgagaccatcctgcttaacacggtgaaaccccatctctactaaaaatgcaaaaacaattaactggccgtggtggcgggcccctgtagtcccagctacccgggaggctgaggcaggagaatggcgtgaacccggcaggcggagcttgcagtgagctgagatcgcgccattgcactctagcctgggcgaaagagcgagactctgtctcaaaaaaaaaaaaaaaaaaaaaatacgtccttgacagcaacaaagctatctagattccatgatcctatagagaatatattctcaaattatttgtgactacctttatcattagcttggtgaagagcaacgatatttatgaaagacagtttaaaagacattcctctgttgtctaattatatacagaacaaagccatgttcttggaccacaatgtctcaaaaccctgcaaaattacttttactaagtttggctttattattttacccttacctcttatgggaggaagtttacaaaattcaatcctgcagttatgaatcttcaataactcaagtattgaaaatttatggcagggctgtctttctcatcttaagcaccaggaaaaaatacttgagctcccttatgcaattagtacactatttccatatataaattgtacatcagatttattcccttcttactttggctggtagaaaactcaagaataaaattctcaggtcaatttttaatagctatgtaacatccatggtctacatatttgcattcaaacaaccccggcctcttatttgcatttgcctttttccagtctttacttttgtacagattttatttcctatagttttatattcatagaagtgtataaataaatacaaaaatatttatagatactgcatatttcctaatagacctattttacccactgacatatgagactattaagaaaaaaacatatcagggaggacgtgaatcttcgtgacttgaaggaagcatcctcaacaaagatattgtgaatcccaaagtaagagaaataaagttcaaattgaagcagggttacagactgtacagagttccagtgagaaaggattatgataaataactgcgtataggaattcttttcaatttaaggaaatttcctgattttctgatggccagggttttgtcctttacctctaaaatttactagaactaaaatgaaagtgagacagaagcaactagtccttcccaaggcttctcatcctggagttctctgtcaagtgggttattttgactgtaaagcattcttttgttttctttgtctgaagtcattcccagattagtttgtgacttgcttgagcatgtttcccagcagtgatcttgggctgtcccattcacttctgacctgcacctgctcttttcaagtattgcaccaagagtagctgaggcctaaacagaggcgtgctggcccattcacagagactattcagagaactgctaggggaggggagtgggcagtgggcgggatggcagtcctccagagaaaaaaggaaagtgaccccttaaatcagagaatgaccttttatttgttattagttgtctaagtaagtgtaaggggaccacctcctccataatgcgctttgtgaaacggtaaatgttacatggcctaaaatggtgcttctgaaaagattagatgaattattggtatttaaaactaattaagtgacatgttcagatatctagacagggcataaaatctattatataactggtgttcaaaaacatttactgtttgttccacaaacaagaacgtaaatgtatttggagacatttctgcatgaaatatatcatggtaacaagggatttacagaacacttactaagtttctcactaaggtttgacattcagccattcaatacttctgttgaaatggtattgtgatttcttctaaatcttcagctccacagttgtaaaagaaggactcacacttatattttatctagtaacctaaaagtcagcagaaattttaaaataaacccactaggtatatttacacatttgccgtttagaacacagccttgaacaagaaaaacagatcataagtcatgttaggtatctgtctgcactagacaagtttacagaaattgttcttcagtttcttttattgagatttttgggccactaatctgttccaaaagagaaaaaaactggccctgaggctcaacttttccatcccaaggatgcttgtaggcaagactgccagcggtaccactgccactctgaactaaaaactgcttgccattcaattattcatattcagcccttctaggggagagaaagcactaaagagaaatagagcagcaaaaatgtagacatagaaagtaggaagaagatttgtaatagttacatgggaaaagggaatcacagaagaatgatgttatttaaaataggtgatagaacagactcaggaattccaataaaaatggacagtacccttggtcttcatacatacaaaatgaaatagtggcaaatatgctcaaaaaggtacacagttccgtgaaatgctgaattacctgatcctctcagagtaggaacaagcccagtatttttaatgcttttggtttatcacctgagctgtgccaggcacccacctccacaggaacttttatcactttgcctacattctcctattatgagttaagtatatttgataccaatgtttatttactaatatacacatgctaggtgactattttgttcaaagttctttccatataaattaagatttccaatactgacagtagcaaacatttataaagtacctcttcacactgacacatgtagattatcaaaattttacacatttgaaaaaaacaaataattatttagaacaaacaagccaaagcagctgctgcaaaaatatgtgagtctatatgaggtacatttccaccatgtaaagtcaagaggctgttgaaaataagaaattgtgagagatacagaaaaactacctccttttcggttatagtatatactgaaacctctcatttatcacatttcatctgactaaaaccaagagaattaaggtgacaattgaagacgtcaccaggggtattttggttttggtttgaatgctgtagactgaattgtctcccccaaaaaatgtgtatgttgaaaccctaaactccagtgtgtccgtatttggagaaggggcctttgcaaggcaattagggttagatgagatcatgagtatgaggccctcataatgcatttagcagctttataagaagagagagagaaagactgttctttctccagcatgtgaagacacagcatgcaggtagttacatgcaagccacaaagagagctctcaccaaaacttgaatgagtcggcaccttattcttggacttccagcctccagaactgtgaaaaataaatgtctttcatttaagccacccagtctatggtttttcttatagcagcctcagcagagttgtaaaatattttgaaattaaaaaaaaaatcactggtaaaggagaagtgaagaagaagaagagggaggaaaagtgaagtgaagaagagggaggaaaaaagaaaaaacttttgtctggaaagaacttgttttataatgtgaaataaacattttgttaaatgctaaggataaaagaaatgtaaagcttgtttgtcttgtatataaatgacaaaaatggcacttttcatgtaatttgagatcagtagacgttaggacagaaatcaacaaaaaatatatctcactgccaaaaacagcagagatggagttcttttttactgaatgttgatgcaagacacaagagaaaactttggggcatgatgtaagaatcaattaatgcacataaatggagcataaatcacattaatgtattgcaatgctcttgcacactttagcccctactgaaacacaggcctaatataaaagctttctcctctgtaggcattaatgactccctccccttccttgtcccaacatcttttatgaaacttcaccactgcacaagacaatgaacctaaactccagccttccctctggattgcaagctactggaggagcacgattgtatgttgctcagcttatgctgtgctcgtctgtccctttctgtccctgctactggccatccaaagaggccggaatcttcactcccactgctggaataagaaagttcagaatgtcaaattgaaatggatcataacttactacagaaggaattattagttatttagagaaaaagactttctcatacatactttttctcccacatctccacctccatcctctttccctgatgcttacaaatgtcttccactgatgctcatgacgataaatgaacacaaaagtctggtgataaaatatagttgaaatagtccattgtaaccctatgtggtacaatatgggttaaattagctctacaaactggtgtgggaacctgttgttttaatgctaacatattgtctgttttccaaaacatttttgcaaatgtatttttggaacactacagccagataccacttacactagtacagtttcagacattatatttaaggggttttttggttgttttgttttgttttgttttgttttgtttttttgagacagaatctctctctgtcgcccaggctggagtatagtggtgcaatctcggctcactgcgacatccatctcccaggttcaaacaactctcctgcctcagcctcccgaataactgggattacaggaacctgccaccatgcccaactaatttttgtatttttagtagagacggggtttcaccatgttggccaggctggtctccaactcctgacctcaagtgatccacctgcctcggcctcccaaattgataggattacaggcgtgaaccaccatgcccagtctatttttattatataatatgagctacattctagcattaatatttaggtttagagttgtaaacgcattagaaatgactgaactagaatttttttcaggtaatttcaaaatatttttggttcttggaatgactatgcattcttggaatccgcaaagtgccctggagaccaccagctaccattaagtaagcagcaattctgcctgttgaaatgacaatacccactgcaataactgcattcagcaaggggaaaaaaatactatagtactgcatattcttcccttttaatcaggcagattctcaactcttactttgagctgcattctcctatggacacttttacataaaatacaaccaaacatcattacaaaggtcaaaatatactttggaatacatttgcacatgagattgaggggaaaaattagtttttgtttcaaaattacattttaatatacttatcatagccttctagagccaaagaagtgcctattaagaactaacactggccaagcactgtggctcatgcctttaatcccagcactttgggagatcaccagaggtcgggagttcgagaccagcctgaccaacatggagaaaccccgtctctactaaaaatacaaaaattagccaggcgtgatggcgcatgcctgcagtcccagctactcgcaaggctgaggcaggagaatcacttgaactcgagaggcggaggttgtggtgagccgagattgagccattgcactccagcctgggcaataagagcaaaactctgtctcaaaaataaataaataaataaataaataaataaataaataaataaataaaataactaatacttagcaaaaacacacagtgcaaatataaatagtgaaataaaatactgccctacatccatttaaagactctatatgcaaaagtatcaaattcctttttattgtaaaaatatactataataatttagcttttaacaatcaagtaaatataattacatctaagcaacaagattagcaccctctacacacattcttaatgtatatagtataaagtggtggcaaatgaaatatattatctataacatggttaaagagttgttgactgtttaattattaattattatacttaagacagttctttgagaacaattaggtcatttcaaatggtcatatgtcttttataaatcattaaatgccctcactatgatggctggtaaattaatacatattgctagtcctttcccaagcattttaaaaaaataagtaaccatagaaaatagtactaacaaaggcagaaatatgttgtgatgtatctcttggaaataagtaagtgtggctctcttattcttcaaaatttaaagcattcttagttgttattccaattcctccccctttaaaaaaagaaaggcattttcttgaatactgttctttatgtgaaagttaagattaatactggatcagagaagatcacatatgagtcaaaaacaaaaacatacatgtttagcaatattgttagctgcttttgcactgccaaatttaacgtgtctttaaattcacaaatgtttaatcatgctgggaagtgccaagggtgataaattttatttatgaagttataatatattgatatgatgttctaacaatgaacagtaccatgaaaacacccgattttatgattcatttagaattgtacttctgagacacacaaaatgaccaagagcacaatagtaatagttgcttattttcttagctaaatgcaagtaaaagtggcaaaggaaattaaagtacattagaatagcttaagtgttcaggttcacagtgaagttgtgcctgttcaaatttaaatctgaaggccgggtgcactggctcatgcttgtaatcccagcactttgggaggcagaggtaggcacatttcttgagcttaggagttctagaccagcctaggcaaacatggtgaaaccccatctctacaaaaaattaaaaaattagctggtcatggtggcatgggcctgtagtcccagctacttgggggcgctgagaagggaagatcacttaagcccacgaggttcaagctattgcactccagcctgggtgacaaagtgagaccctgtctccaaaaaaaaaaaaaaacaaaaacaaaaacaaacaacaaaaaaaacaaactacatctgacctaatctcttcaactccagatcttcctgctggcagggttggcttcttcttatataaaaacaggaaagaagtactgactttctatttacaaattcacttgaatgctacaaattagtaaatattctagaaattttattatatttcacaatcaaaggagatcatggtttatttttatttggtttggttattttactagcagctaaatggacatgtgacaaactacagaacagatggataagaagataaaatccagatgttttgaccacgaatgctcttttctgagagcaaaactcacaaaattgtgaaaataaattcaggttgatttttcgtttttcacattattgtccacttcagataagatccaggaaggtcatagtatctctgctgttagcagctttaggggacatgagagtggcaggagaatataatcaagggggcaaagggcaagccaggtgctacaaggagcaccaaacttgcggttccagttgcttccccagagtgggattttgatttcatgtgaggggaaaaaaagtttgcttaaagtttatatgaggtcctgtacagtgtgcaccttctgcagacgagaaaagaatgcttaagtttactgtaacagcagtatgtttaagatctctccttaagattttatcctctaaacttttatttccagaacaaaatgaaaagaaaccctgcaattaaaacacatatattaaggtaggccgggcacggtggctcacgcctgtaatcccagcactttaggaggccgaggctggcggatgactggaggcagggagtttgggaccagcctagccaacatagcaaaaccctgtctctactaaaaatacaaaaattagctgggcatggtggcacacacctgtaatcccagctactcgggagactgagacaggagaatcactttaacctgggaggtggaggttgcagtgagccgagatgccgccactgcactccagcctgggcaacagagcgagactccatctcaaaataataataattagtatatatatatatatttatatatatatatatatacacacacacacattatgtgtatatatgtaaaggtatatgtatgtaaaggtaaacaagaaaacaaggatgggagttttttttagtcccttttgtttcttagaagtttcttaatagccagttttttttatagaaagttattattttgactgttatctctgccaccctgcaaacctcttaatgcatgctcaagattaacgaactttgaatgttcatgttgatagtatttaacaaacactttgatcccaatattcatttacgtattacgcatgctctgattttcataaagatgtcctgagttcttcacttccattcttaaatatatattctgttaacaacacagcatttagaagtacagaatgctaaatggtatgaggtgttatctctactgaactgaactcctagtctccctgccccctgacatttctaatcaggaagctggcccacttagctgatgtacagattcgatgcctcattcttacttgatgtatgaccatagaaattccccatctctattagaaacccccagtctctgtttccccatctttaaaacacagttaactgtatttaatttcctgggttatggggagaataatatgaactaaggtatatatccttaataaacttaaaataactgagcagagtgccttatacacaataaacattcccataaatagatgtaattgttttgaagttaaaattctgacgtgtttgtttaaagtctccataagttaaaatttattgataagttaaatatatctcacgtgttctttgtgttgttacttgagtttttaaaattgcatatgcaacatgagctcaggggagaagacacttccagtctgcggaagtttctctgaggtcttcagggaataggacagaagaagcaaaataaagatgagctcatattccagaaatctgcaaaggtttacagaaagggcaatgtaggtgtggctcatttgaatgacaatcagtagaacactctactcaaagtcagtgaaattagctgtaggaataagattggagacagcaattcctttctaaggtcttaaccttcctctaacagaaagtggagtcaataacgtatctgtgttcaaacctttgtatttctttggagtaaaaagaaaaacctctgacgtgatcattatacactgtgtacatgtatcaaaatatcacatgtacccaagcaatatgtataattatgatatgtctatttaaaaatttaaaaaaagagagaaaagtctcttgggaaagttggtattctccctgctctcaggtaattgagcaaacctggagttgaaatagggttgaagcttgagaagctctttagggatttcttaaggcaaatcttaagaactaaaacatcaacaagaaaagtcaattatcgaagaagctaatgcaaaatgactagcaagagtgtaaaatgctacttctagaaaagtggtttatggagccattactgtggatgtgtatggttccagagatcctaggaagcccagcccccataccacctattcaaacgactcatgtgatatattttttccttgcagtgtttaccattggttatggaacagcaccaccctcacacacataaaaatgtacaaagctctgtatccaatatagaaaacatgaattactgaagagactaacagggttataaaaatgaaaaaaatttttttaatcttttcaaagaaattatattatttttagagaaatttttctttcatgatatagtagctccatttactaagggtagttttatttaaggctcatgctatcttgacattcacctcctttttttccccatgaaaaacataaaagagatttgggttttttcctccttctaaggtagacagtgtggaaaggcagaaaaaaaggccaaaactctgccaaaaagctgtacatctaagcaagacaactggcccattaacaaatgtctccatcaatatcttaccatctgctgtttgtactgtacttgtcaatattgagcatcactcacagttcatgtgaccatataaaatctcagaaagcacagagtaccaaggtgggaaaaaaaagcaaattcaaagatggttttagaatctgacaacacattcaccacacaagtatataattagatggaaacaagttatgtactttgcatgctttatgtgtcaaaggaaattcctcataatttctaacagtagattgattatgactggcaaaccatgcagtgcagtctccacttctccctctgattcacctgactttttgcccactcatctaaatcagaagctcagattaccagattaagctgcttaaattcagatcagtgaattttaattattcatgttataaaaggatactgatgttgtggcacacttagataggatatagcccaaaaatgttacactggttttattaataaataccttaaatgttttccaacaatacaatttttttgtcttttatgttttgtttctttgcacagattcaaaggaagcagaaagcaggagttgtttgcagaggtacaattgatagtcccatgtgacggaatttaaaggggactggaaaggggattccttaagggagatcttaagaactaaaacatcaaccagaaaagtcaattagcaaggaagctaatgcaaaattagtagcaagaatgcaaaatgcttcttctagaaaagttgtttattgaaccattactgtggatgtgtatggttccaagatccttcccaacttttgtctttctgagtttgacataaactttcctatttcattaaatattccttcatttgaaaatattgctgtgaagagtgacactgatagtggcaagaagcagactaatccctaggcagacaggggcaggtccctggtgaaaccagaccttcaagccaaagacactttaaaacctaaaagccaagctacaagttaaatccatggactggattaaaaccctctcttcccatgtggcacactttcctctgattgatccttacccttcacttagtttacataaacctacccttccctaattggtttttcatgctgtcctgccaacctttgaatgatgcctttgttttagcctcttgcatactcacaaaccaatcagcacgtgctcccccattatgagctcataaaaggcccagacccagccacactgagagagacagaccacccaacttcaggtggggggccaccctcatgtcccctttctgctgatagctgttctgttgctcagtaaaattcttctctgccacactcagccttcagttgtcggagtaacctcatttttctcagacgcgggacaagaactcgagaaccatcaaacatgggtacaagccgtaatgcaggggggctgggacacactctgcccagccatgggctgagctggtatgcaagccaggcaaggcccagtgggctgagtgagtgtaacacctcctgtggcaggcctggggccaagcaaggcctaggtgggggcattgctggccacagaagtccctgactggcaaagtggccacgaaaaatcctgcatcaacatgttcaatcattaacagtttagaatgaatgaatgtattaacatgattggagaatagatagtatatgaacactaggtaccttggggaaaagaaaatcattgggtcttttcccatatcaatacaacaattccaattagaaatatgttgctttggatttaaatgcttgagtgcctctataaggcattgggaaaaaaacagacaataaataaatttattagccctaaccctgaaagatacagttatccctttcctacctaatattctaaatttaattttgcacacaggttataggtaattggtcttctaactcagtcctaaaaaattcaaatacaataataaagagacagagagagaggaaggaaggaaggaaggaaggaaggaaggaaggaaggaaggaaggaaggaaggcaggcaggcaggcaggcaggcaggcagggagggagggagggaggcaggcaggaagggagggaggcaggcagggagggaggccgggagggaggggcaataacactttaattgccttgaaacagcacttgcatataaaaattgtagctatatacaaacatgtaggagtttaatgaagtaacagaaatgaatttcatcttgcaatagggaaacattgacctcttatacaaagaacagcagtaagcatgctcttgaacgtaatgaatatatgatccatgctggaggcaacagaggtctgtgcaagttatgcaacagctcaaataccactactgtatccatgttaacaaaaatataaacaaaaataaaagctaataagatatatattgaaattagaaaatgggattaaaaataaaatttaagcccttggctgttttatttcaatgtaatagcagatataaaagatgcagtttctctgcattcttatattttaatataacaaacactgagaattgaaaatatgcttccaacaattaaaatccacctatacaaatatctgtccctaccagtgactaagctctcgggtgtggctactaaatgctgcactgtatttatactaaagctttcatttgcatctttatgatataaacaagacaggataaaactcttaaaacattgtaaaaaaattattcctaatattcgaaaatttaaaatcatcaaacaaatgtgtaaaataataacatttgagttactgatatatataatttgcatacattgttttatttacagataaacagacacctcatagacttctagtgtagcatcagtgagaaactagcagcaacaaccctttgttgaaatgagaattagggagcaacagaaaggtggagtgagaagaggcaaagaaaaatttgcccaaggtcaagttgagaaataaacaaaactttattgagactgtgctgagaatatgcaatgcaaataaataaagcatattaagttcgccaatagaggcaagtaaaaggtagaatgggactcaaaggagggttttattaactctaggttgaaaatggagggggaggggtcaaggagggctccaaaagacacatttcttgatacgtctacctgcattttaaatcacaatcgagtgatttttatcttattcctcattcttctttataaatcttatagagcttagaagaaaaatgacaaaaaggaaaaagaagaaagagaaatctagatgaagggagggaagaagggaaagtgggagaaagaaaagacgaaacaaaggaaaaataggaagaaaagaaacaagggagaaaggaaggaaaaataaaaaccaaattttctctgtattaaatgaaatctatcatcatagatgataggtagctagacagacagatggagatggatagatacagccaggttatcaacagccaagagcagtacaagtttgcttcaaagacattttttgagagttgtaccttgtatttgagacacagaaaaatgaatcattcctgaagcggcaataagcaggtggtttatttcgggtaagtttttaggggcttttttggttttgtttgcttgtgtgttttcccagaatcttgtttcataaagatttatcaaattcaggatgaactccaccattagaagtaaaagaaccaactgattttctgtgagacaaagagaagtgaaggagaacagaagaaacagaggttcaaggcaacttcaaacttttattagtgagaatgtacataaagccatagctctcccctctgggtttgactaaagtgaaccaactcttagatacaaatgtgctgccccagatggagggcctttctctaaaacaccagcttcattatttttttatacttcttttaccatcagccataataataaaacctaatgacaatttcaatagtaaaaattagcatttcccatatttgttagttgctactatctcctatatttgctaagaattctggtaaacagtatacttttgaagcatcctatgggcagataatatagtcattccactttgcagatcttttcaaaaaaatgtatcaaatgcctgttatatgttgagtactattctagacactaaaaacacaacatcaaattaaaaaaaaaacacaaaaaaactccaactctgatggaatgtatgatatgatggagtaaactgagctagagagaagtaaaagatattttcctggtattgcacaccaagtaagtgacaaggtcagtgtcaagcagtctgattccaggacagcttcccttacaccatgtggtttgctgccatggaagctaatgcatacttgccaggggttatccacggcattctgcttttcagattttaattttaacgctttgtattatattagtagtaattcaacgtaatgtagttacatatttaaaaaccctctaagcgcatgtctcatataagcatgtaaggcacttcaattactataattatttcatttaaattcattgataaaatgtgtattctaaaagtgactgaggaactgaattgaatattatgctgttcatggatatgaacaatagctgagcacaattaatagtctatttgggtacaattaatagtctgaaggaagttggactaacaggcatgcctacctgcatttataatacaacacttcagaccatggtcaatgtttagtattatagtaagtatgtattttctcagcctatatgctagaaatattttctagcataaagaacacaataattggaatcaagcagactgctcatttaactactttgagtcccaatcattggcataaaaaaaataaaatgggcataaaacacattcccaacatttgtttgataggcttaagggagatgatatatgtgaaaatcctatgcagactacagaatgcagcatcctttataattttctcttttcagcattacagaattgtttggactttctaatatattttattacttttagtaattaccagttaaaatgttcctatgcataactcaagataaaaataattcgcccttaaaccaacctcaaggtttagtagccacttttttctgagttgaaattaccttttcagctttcatagaggccttttattctctcagctttctctttccaggctgggtgcagtagttcacacctgtaatcccagcactttgggaggctgaggcaggaggatcgcctgagcccaggagtttgagactagcctgggcaacacagcgagaccccatctctataagaaataaaaaattaaaaaatacataaataagatttctctttccaaatccaggttttgtgtaatttcaagcaatgtggaattccagatataatcatatagttccataatctggctctttaaaaatgaaggagaatatttggatagtcttaaatcacctaaggtttcttaatactagtatctgtcaaggttaattcaccactctgtggctacacaatatatgtctgccctagggactccttgtactagctacttctttacgtctaaatagctattgctcaatttgtaatactgcccctcacttctattcactgtctgtacccttttacatgaagctcattattatcttgaagcttgactttcctggcagtagtccttctacttcttatatccaaataatgaaggaaatctaactataatgaaaccaaggcctaaattactactcaaaatattaaagtgtctggacccacattggcaacataataagcatggaagaaatcaagtatatgtagacacaaaagtttgctacctcctcattgaaaagaactaaggttcctttccattcatattccttaactgaaaacaaaagtctaacagaattccaaactagagattaaagtccagtcacatctttccaaccaatttctgacactgtgaattgaaatgcgtttctttttgaacttatgcattgatttcttcatgtctttcacctgtttctaggtttttcataaaagttgcatggtcctccccaccccacctccattccacaccgagtaccaaccaaaatcatttggtcttggaaccaaaatccaggaggctttcatcactaactcgctttccccaaaaggattctggcttttgtttatcatcagtacttggtctttctccaactaacaagctccctgccctcacatgtataacctgtatcattgtatttgtacttataacctgtatcattgtatttgtacttaaaataaaaaaattgaatattcttatatgaatctaaaaatatatttttattttaatatacctatacttggtatatttcagtcttctcttagctctttattcttctgacattcttttggtccttcgttttttttctttgaatatacttatctaacatatatttgtgtttatgaaagtatttttatattgcaagtgattattcttaacaatattcattttgcctagaattgagcatttaaaaatacagaagtctatgctgacagagtacacaaaacagtgaagaaatacaaaggcaaatcagtgattaaaatataatgcaataaggattttcatgaggtatctgcacaaggagcaatatcagtatagaaagtagcaactgattccttctgacagccaaatgtattgagcatatattgccatattaacgaatgtgctaagcacatatgacccatttaatcatcgttaccatgctctgtgataggcgctgttataatcatgagacacagagaggccaaaaaacagagctaacaccgtagcagagtcaacattcacactgcttattagataaaacttactagataaaactctgaaagactaaatggctcttattagacaataaaaggggaaaagagcaaactgggtgctggaacagaatggccaacacccaacagtcatgagtatattaagaacctggtgagagataccagtgggataggattagatagatgaagagagtggctaagaatgaggcttcatagacaggctatgtccaactactctttcgtctgaatatctaaagatgaagtcactccttaaacatttagactgtatgatgctaagattaaactacaactattaaagaaggaagggctcaatagccttagagccccagtcctaacatttaggggagagactaaaaaagtaaggaagaaagaacacagctggaagagaaagatctcaatttcttcatgatttttattgcagcaaatcaacaactttactactccctataatttaacagtctttgccacagtgaagacaaacatcattccattcaggaatgtgtagcaacagaattctcaaatcagaaaaaagaatgagttttatctttgaaattcttaattatgtggtgagtaaatacatatgtgtgtatgtgtatactcacactaacatatccacagaattgaaatgctgttgttacacacaacaaaaaataagtatcagtttacagatgctttgttcatttctgagcgaggtctcactacactaccacttcagtttcttttctttctcctttttttttttttcagatagggtcttgctcagttgtccaggctgaagtgcaatggcataatcatagctcactgcagcctcaaacccctttgctaaaggggccctcccacttcagcctcccgagtagctgggactacaggcgtgcaccaccatgctggctattttttaaaattttttgtagagatggtggtctcaacatgttgcctaggctggtgtcaaattcctgacctcaagagattctcctgcctcaccctcctaaagtgctaggattacaggcatgagccaccacacccggccccattctcccctttttttttccttccttctacccttctttccttccttccatccttctttccttttgatattccttttactctttcattctttcttttaattataagctgaggtgatttttataagggaacagagaaccttctacatttgaatcaccaattcaaagtagatcaacacactcaccaaaatctggctggtttgtgattagtatgagatgaagtttaaagtctcataaaaatcagagtcagcactaaaaggaactcttgtttccactcaattctatttctgtattgtaacttagcaaaaactctgttttattgggaggccaaggtgggcgcatcgcctgaggtcaagagctcaagaccagcctggtccacatgacaaaaccctgtctctacaaaaaatacgaaaattagccaggcgtggtgggggatgactgtaatcccagctactcgagaggctcaggcaggagaatcacttgaacccaggaggcggaggctgcagtgagccgagatcgctccactgcactccagcctggacaacagagcaagactccatctcaaaaaaaaaaacaaaaaaactctgttttaaatagctatgtagaaattcaactattttcacaagatagtaaaacaatttagaaaaaaagttcttaacaatgataaaacaatgatgaaacatcgtttacatttcccatttataaacaagcagacagggagactggcgaatcttgtatttacagttttaaatcacttcctttttataaacagataaaaactaattagaagattccatctccctcccactccccacccccccagcccccacccccaccccatacacacaccttcgttctttcaattttataccttccatcccagaaaaaaaactaaacagttcaaaatggggcacttgggagacatcactgcaactgacccctaccttcactacattaaaggtgcctaaactataataggaaatcttctacatttaagtcgctaattcaaattcttccagatttccaggtttgtagcatcacacattcatttattcagccaaatttgtttagcacctaccacaggcaagctactccattaggcattagaaataaaaagataagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagcaaggcattggtagcttgatggggatggcattgaatctgtaaattaccttgggcagtatggccattttcacgatattgattcttcctacccatgagcatggaatgttcttccatttgtttgtatcctcttttatttccttgagcagtgatttgtagttctccttgaagaggtccttcacatcccttgtaagttggattaaaaacaagcaatggggaaacgattccctatttaataaatggtgctgggaaaactggctagccatatgtagaaagctaaaactggatcccttccttacaccttatacaaaaatcaattcaagatggattaaagacttaaacgttagacctaaaaccataaaaaccctagaagaaaacctaggcaataccattcaggacacaggcatgggcaaggacttcatgcctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgaagccaaaaaacacatgaaaaaatgctcatcatcactggccgtcagagaaatgcaaatcaaaaccacaatgagataccatctcacaccagttagaatggcaatcgttaaaaagtcaggaaacaacaggtgctggagaggatgtggagaaatagtaacacttttacactgttggtgggactgtaaactagttcaaccattgtggaagtcagtgtggcgattcctcagggatctagaactagaaataccatttgacgaagccatcccattactgggtatatacccaaaggactataaatcatgctgctataaagacacatgtacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggagactgttgtggggtgaggggaggggggagggatagcattaggagatatacctaatgctagatgacgagttagtgggtgcagcgcaccagcgtggcacatgtatacatatgtaactaacctgcacaatgtgcatatgtaccctaaaacttgaagtataataataaaagaaaaaaaaagaaatgaaaagataaataagacattcatttattccctcaaaatgctgacttctagagactggaactacatcagtgaataaaaaggcaaaagtttccatcctagtaaaacacacattttaatggggaagacagaaaatgtgacaaataggtaaaccatatagtgtttagtatttacatgcataagaaaaaaaataaaattgggaaatgggatagaaagcgcgaaagcagagttgtaattttagagaggtagacagggtttagtttcttttttcacagaactcagtaaagaaaggctatcttttcctaaaaactatggcaatacgatgtgataaatgctactaactgattgacaaaatgtgaagattacatgatagagctattgattgctggagaaatcacagagggaagaaatcatctgaattctgaaagagaagatgacattcacaaggaggctgggaaagaataggcaaaggaacagcatatgcaaagtcagagaggcagcatttggcaaataattgctatttatcagcagatagtagcaattaccataaaattcagaacgtaccatgttccagatactttcacacatcatctttattaaccctcacaataaatctgtgggcttattaatattattcctatttttaaaataagagcaagaccagaatgaagatagaaggagagacttgaaaaaatctgttgaagtgggccaggtgcagtggcccatgcctgtaatcccagcactttgggaggctgaggcaggtggatcacaagatcaggagatcgagaccatcctggctaacatggtgaaaccccatctctactaaaaatacaaaaattagccagacgtgatggcgggtgcctgtagtcccagctattcgggaggctgaggcaggagaatcgcttgaacccaggaggcggaggttgcagtgagcccagatcactgcacttcagccagggcaatacagcaagactctgtctcaaaaaaaaaaaaaaaaaaaaaaaaaaagaagaagaagtaaaataggttgaggttaaagagtttgaatattatcctttaaacaagtcaactgaatgttttaaaataaagaggggacatgatcagaagttacgggtttttttaaattgtagactgtagtgtggagaacagatcattggggttgggaggcagaatgataatagattattatttataataacgaaaggctataatttagttaaaatgtggcaaaggcttgaccttagccagtaacagtggaaaaattaaaagtaggataagaaaaacctggtagccaactaaatttgggtggaaggggaatggaagggcataaaaaggggagtattcagcgaattctaaatgttctaacttagaatatctagagggtgacactattagcaaagaaaagaaaggtaaggggagaagactgggagaagagaggacggagataaaaaggggtctaagtttgaacttcttaaatacatcttggtgatactgaagtcaagaaacccagtgggcctgaaatgatgaccagactgattagagaaagattttggaggtaatacatttgagaattgttagcaagtatatctttgtattagttagaatttttttggtagcaaaagacaaaaaactcaaattgcttatacaagtaatgtaaactctttttggtcggttgtaaagtctctaaaagtaaggtggactttcaagtgtagtttagttaggactccagttctctttctctccaattgttctcaacttgtcttcttccttgtatcatgtcatcatggtttcacttagggtagcaaaatcatgtagcaatccccaattttatatctgcatcccacaaaacccagaaaagaaatattctctttgctacttactgaacaatagtgctaggcatctttctagaagcacttgggtgtcacacccaccactgtcaaggttgaagagatttcactgattaacatggaatcagcacccctaccccaaactatatggatactacatcatgggggaagaccggaattaatgctggggaagcaatcccagtgtcctcctcaatctccttccaaggctgacagtggctaattgttccactacgtagcaggatgaagtttttatgaagtcacatctgaaagacaaaagtatttttctacaatggacaaactttttaggattgagcttccaatatcatccaaatccaactacacttccttaccagaggtaatgacaaagtaaatattcaggctatatgagaaactatatttaaaatgtaagtagtgaatagttttcataaatgtgaacgaagaaaatctagcagtgttaactaagaattcactttcctcttcctctatctgcctctcaccccaatctctacagcaactcagtagccaaaggacgacaccaaggaacacagaccaaagagtcaaaatcttggatgggagttctaaataagttctggaaactctggagccaaaagaaagacagggaaagagccgataaagccctatcacctgcaggaaacttctggttgcaatgaggacacagagtgacatgtgcatccaagagggcacggcaggaacatggagagcgagggatctgtagtagggacaaaggtcagaacagattggcttcatttcaaaggatgctagatgaaccctttctttccgaagcctggaactgtttaggccttccccagatcttaattgacacccctggttcaaataagttagggaagaatccttaaatgagtttaggtgaattgttaactagcttaagttttcttctgagatggttaagaaggggtcaaggttgaaatgaagctcaactgtgggggaataaatttagttacatttcttgcacacttgtttttgtaatgcattaaagaattttgtttaaagcaaaactctaattccacacttggcaccatttggtaactttttaaaactaactcattatttcagaccccagtcaatactattaattttacaactgcagaaaagaaaatcataaaactgtaccctgtgtctcatgcagtgtcactctgtagtcaacaaaaaagatatttgctggatcagtgagtcgagagagagaagtgatttgccaaatatggcccattagagtactaagaatttagggttaggtttcagcatttgttgctgtcattcaagtactaaatttatatttacttgggacagtgcgtagagtttgaatagcagaatctaaagcatgtaagacactttcctgatttagctcattttgagagttattctcattgagctagaatgtttcaaaaatggttaaatacaacttttttggtactatgataacttttgttgaggtaaaatgagttagcaaataatactgatattctctttatcatttttaaaattatctaattactcatttagaagtcactgttcttgggatttctggacacaaaacatgctcagtaatggaggacaataaatgctctcaatttacaagtgaagatgtatgcctaattagacaatagtagtaacataaaaaaatagatggttaacacactttctttttaaatgtatgtatcaaatctgttaatagccttagaatggtcttttactaataaaaggacataaaattaaggtttaaaaatgtagatatctaactaaattaaggcattcaaatgagctaaatttataccaatgggatcacacttacaaatctgggagaaattactttacttctaagtaaagacattgcaacatccctgggaaaaattaacactgatcttacaggaggctactgagtaggaaaatgaatgacaaagtctaggaaatcatactgtggctgaatgattaacagaaatgcatctgtgaaagttagaaggagattccgaggaatgacaagtatacataatatatgtacttacatattaaaaaaatgcaaattatcatgactgtacaattggaactacttttcaagtgtggggattatagtttgagtggtgtctggtggaatacattctccaacccatcatcaaagtgtgtcacatcctcactctttccactttgggtttatagtttagatgcctgtgctacatacaaaaagaaaagaatgtatttttgaggagccctggctcagaaatcatagctttggtgttcattttactgcttttgggggacaaatctttttttatatatatactttaagttctagggtacctgcgcacaacgtgcaggtttgttacatatgtatccacgtgccatgttggtgtgctgcacccattaactcgtcatttaacattaggtgtatctcctaatgctatccctccccctcccccaaccctacgacaggccccggtgtgtggtattccccaccctgtgtccaagtgttctcactgttcaactcccacctatgagtgagaacatgcggtgtttggttttctgtccttgcaatagtttgctcagaatgatggtttccagcttcatccatgtccctacaaagtaggacatgaactcatcattttttatggctgcatagtattccatggtgtatatgtgccacattttcttaatccagtctatcactgatggacatttgggttggttccaagactttgctattgtgaatagtgccacaataaacatacatgtgcatgtgtctttatagcagcatgatttataatcctttgggtatatacccagtaatgggatggctgggtcaaatggcatttctagttctagatccctgaggaatcgccacactgtcttccacaatggttgaactagtttacagtcccaccaacagtgcaaaagtgttcctatttctccacatcctctccagtacctgttgtttgctgactttttaatgattgccattctaactggtgtgagatggtatctcattgtggttttgatttgcatttctttaatggccagtgatgatgagcattttttcatgtgtctgttggctgcataaatgtcttcttttgagaagtgtctgttcatatccttcacccactttttgatcgggttgattttttcttgtcagtttttcttgtttaagttctttgtagattctggatattagttttggggacaagtctttatctgtttcaatcttagaatttttttgtctcattaatttgttaattttatgctttccactttcttttcaactttatccagataattcctcccaaaaaataaatattcaataactataatgaatcaatgtatgttttagtaatttcatatgataggtccacatatataaacactatcataacaattaattaccctacttactacccctctataaatatgataaagaggccttactggcagatctgttaatgacagttttctgtcccaccaaagaatgtgattgatatagacaaagagttgcagcacggctcaaattaacaactgcctgacaggtgtcttcaactctgctcaagtgaattctgtgacatctgcttaccagagagcacacatataaggtgtgtgagctcactttgctagactatgaaaatgcatttgaaatccaaagaggaagtagaaaatgaatttgacaaccatatttgaatatctttccttgggttagagcttctcatatcactaaataagcaaagtaagatatgagtacaccaaatgactcataatatttctttacttctataaaatgtaatcctctatctctcaaatattgaaagactactactgttatttattaattgatttttttcttgatggtctgcacattggtcacaaaaatgtctagtaagagcaatgcttgctaaaatttttgaatgaagattccttttaacaatgataccaatttatgctattataaattcatgaagatttccaaatacaatttattagtaacaacagcattgacatacagttggaaaattgcaaaaattattatttttagacaatttaggtgggagaaagataaataagacacagcatctgcactttacatactatagtgtattaaataagagttctctggataagtgttaattaatgcaactctattcctggggactagacactgtagaacatagtatttgttcaataaatcatttttgaacaaataatcatttctattgaactgatatagcccatctatccctgatagattagggattctatgcctaatagatatagcccatctatccctgatagattatcttctaaaatacctagaagatattcctccttcaataatcttcaatggctcccaacttccatcagaataaaatatattctttgcattaaaaggactacacaacccggcttgtactttcttttttttttttttttgagactgagtctcactttgttgcccaggctggagtgcagtggcatgatcttggctcactgcaacctccgcctcccaggttcaagcaattcttgtgcctcagccttctgagtagctgggattacaggcacccaccaccatgcccagctaatttttttttatttttagtagaggcggggtttcaccatattcgccaggttggtctcgaactcctgacctcaagtggtctgccatctcggcctcccaaactgctgggattacaggtatgtgactcagtgcctggcctttccttttactttctttttatctcctctcatatccctttacacaaggcagcacagcagagtgagaagaacaatgcttttgagaccagaatggctgctgggacagtacacgaaacctgacttactaatgtatgatactttgtatgacatctgaatatatgaaactctttgaacctctctttttactaaataaaggtaattaatacctgggggaagttgtaaacataataataaagatacacttagcacatacggcacagaacagatcctggacatgtactctgatactgttgagataactttctctcttttttcaatcaagttgtatactttctacttttgtttagtgttttcttccttctaaccttggactggaaaatccaccctattgtacttgggcctaaatcctattccattctgtaagtcaaattgaaagctaccattttacataagcaccgtattcaggtaccaggcagttgtaaacacagcgtagtcaactaattacagatggtcccaagaaattttatgtacacagagaagacaatttaaggcaattttaagctaccaacaaagcttcaaagatactaaagctttaagagaaaagacgtgatggggaggatggcaaaccaacaacacggttaacttcataaatgtcatagcttctgtgaaggctctgtgacctcatgagcccagagttgtcactctttttttttttgcattcattattgaactattgtacctagctgtgaggcacacacagctttgaaatattaattatttctttggctatatctataagttccccagcttgtaattacttgagaacaaataaaaggccaaaatccatagtctttccagtgccttctatatagtaggtattcaaccaacatttgagtgactattacttgtagattatcagatactgaaagtcttgtgactttttttcaattatgttagtacattttaaaatgttttttctgcaagtcatgcaagccaaatatatgtggatgtaaataattctgaatgcaccttacagagttccccaattttttaaaggtctatttcttctggtagcctcttaatacaggaaactgaaatatgaagaaataaagtgtggtacccaacatgatgcaagtattggcaaaagcagaaactagttactgttaggttctcctattcagtgattctcaactttggctacacactaaaatcatctgggtaaattcttaaaaataccaatgccaggccaattatcctcatctctagggtagggccaaggcgctggtaacttttttaaattccccaggcgattcaaatgtgtatctgtggtataaagccactgtacctctcgtaattccaatgtacaatgtgattgctgagagttcctgagaaaatcattgcctaaggtctctttcgcacactatcgttttctgggttttaaatacagtcatgcaacacttaatgatagggatacattctgagatatgcattgttaggcgattttgtcattgtgcaaatatcatagagtgtacttatacaaacctagatagcatagcctactacacatctaagttgtatggtatagcctactgctcctaggctacaaacaacacgctacggtactgaatactgtaggcaactgtaacataatgataagtgtctgtatatttaaacatatgtcaacatagaaagctacagaaaaataaagtattataatctcatgggaccactgccatatatggggcccatcattgaataaaatgtcattatttggtgcatgtatttgaaaccgtgcatcttaaactattacacttacttttctcctgagtagcatgctttagataaacctctaagtaatagttcctctagtttcttcagaaacataaacacacatgcagaattttagtagaaaaaaagatgctctactttattacaagaaaaggtatgtttgtgtgatttgagacttttacaatatctgcttaggttgtgtaggggaggccctaaaatataccttttcatcctttccttatgaatcaatccatcatagcggtttacctaatccatttttattaaatattgtttatcacttctgtactgctatctatccaacatctttcattctgattggcttagccttaagaaaaaactaacgcatgttaacaggcagtagaaaaattacctctttcatgagctcagtggtctgaaggtgcacgctacatcaggggtggctgatgccaggtggctggcttgcgacacttaggaagtccctcacacctgtcaagggaggcagactgcaagagagaaggcgagtctgactgagcaggcgcgtaagggcaaatcctgctcccaactgctgctagcagagctctaaaaataaagcgacaaaagcacggggaaggcagaatgaattcttaacacttgtactcttctatttctgtctgttacgaagcaggtgatctcagtaccaagcgatgagtcttttaactttctatatccctcactttcagaaatgatcctcatgactgcattcattccagctgtttcaaattcataatcataaaaggaatcttttttaatctttcgagactgccctctctctcataggattacattctaaaataagcttctttgatattcatttgcctatttcactttgaagatattttttcacatgtattattctggaaaacaaaatgtttattcctttaatactttatatattctttgagagaagcaagagttttaaaagccattcctttatctagagagtgtcttccaggtaacaatcactagcctagagaaagtgaaagtatgaacttgttagcaacatcttttaatggccctccaagtaaggccatatttattataaatgttattttaaataatctggtgcctgagcagctctgcgtgagaggggaatgcaatgtagtggttgagagaaagtttgaaatcagatagacctgagttatagccctgccccactattactgtctatatagtccagaacaggtgatttattaactgctcaatacttcagtgtcttcatttataaaaacgaaaataacatatttccctgttttatagaattgagaccagaattaaataatataagcaaaacactaccatactgcttggtatctagtactcaatagatgacaccaattattattattgctaacaacaaattgttaaccaaataaacagctgatgattcaaaagataaagaagtaatattatttaaaatatattgctgacattttaaaataagcacctatatgtacatccaagaatctaaaacctcaaagcctattctccatacaggtatgcggacaccttgcctcttcccattctttctggtatatggagcagaagaactagaagtagaaaatatcttggggaatttttcctgagtagcagtcttcactggagacacttctgcattttaaggcatttctcgcaataggcatgcacaggacatgtctaaatttgctgagaagtaaaaaaaaaattcacagcaattcagagtacctcaggatgttaaactccttacctcaagccaaacgaaaactaaatctcacacacacacacacacacacacacacacactccccattatctggatttgcaaatccccaaaaaaccctctttcatagttaatcattaccactttacctaaatctcaaatggtgctgctgagctgccatccacataggtgtcaccaaacacatgacaagtcatttttaaatataaactttgatcaagacaccaggcctgtatatatacttcaaaacatcaggtacataataaatatatacaatgttatctgtgcattaaaaacacaaaaaacaggccatatctcacatgtatttgtatctagacactttgatcagtcttccaaaaactgttcagggcttcacttacatatttgtaactgtgttcaaagctatcagtgcttgtaacttttttttttttttttttttgagacacagccttgctttgtcacccaggctggagtgcaaagacacaacctcagctcactgcaacctttgcctccagggttcaagcgattctcctccttcagactcccgagtagctgagattacaggcacgggccactagcccatctaattttttgtatgtttagtagagatgcggtttcagcatgctggtcaggctggtctcgaactcctgacctcaagtaatctgcccgcctcagcctcccaaagttctgggattacaggcgtgagccactgtgcccggcctagtgcttgtaactatttaaaccatttcctctgatttggttctcaaagaatgtggaaatcatttgttagtctcttggtaactgctcagtttatttctgaaagatataccaagaattgatgattttctaatcagaaaatatcacgatctgatcagaaaatcatcaattcttggtctaagtggtgaaaattatgcagaaatctatgttaaaaagtacttgatattcaaaaagtctatttagagtgaacattatacatctcccttgaaattatcaaaacattttgttaaattcagaattaattcagaattaataacagaaacatttcccgttatttttctcaaatgacaaaaggagaaagctctaaagtgtttataagccattcaaataagcattaacagtttgttaaaagtatttagtttgctaaattctcttaactgtaataatttaatcttaaaaattagagaagtactattatttgaattagtcccatatctatatattatttctatgttttcatgtcgaacagattttgataagactacctcagtatttctcatataacatctccaagtagttcgtaattgaacatttcttagtcaatcgcttttaatcttttatattttgtctgaggaacaatttttatatctgtgcaaaagaaacttcatattaatttattaatttttcatctctaatatttaacatttacccaaggaaaatgggttatcagcaagtttatttctactcatgccctggtttctctgccaaagaattgttgtgtctgcattttcaggccagggctgtgaagtgcctcttcagagtcttcccacctctgcctggctgcagagcttcactctcatgacccacatctccctggggagccccaggacaatggctgacattgggtttggctctcaagccccatcattccttaggaaaataaatggacttgttctattattcatacttggcagaaaaacatttgttgagatattaccattctttcccaaacagctccattataaacaatgagtcttaattgcagtcaaatcctttgtaaagacaaagtaatttaggaaaaatataaagcttttaaggtggtagatgtaaatacttaatgtgttaattattgttaaaatgagcctataagtgatctaagaaacaatcttgttctattggctttgtttcttcagagactaaatactgcttgaactatgatgggaaatgcttattaaattatttgattaatatatacacacatatatactcactaatacagaatgtaatatatatataaaatgaaaatataccatgaattattttattaatgatatactatcctgaataaaagtttaactaatgaagtactagaataataatctgagatgtaataataatacagtcaaaattttatttagttggtcaacaaataaacctggaggctatttatgtagcaaaatcatagcatgcaattactggtgtctgcacttcatcacttctaatgatgtccaaacttcatttcaattacaagatgagctcagaaaaagcagtcctcaagcagcccattcaccaacctaaaggcaagattaatggtataaattccaagatgatggcttactgaaaaagatgaatagcctgatatcacatgtaaacattgtgctctacagtcttcaaagtattcacatatacattgcctcatttgaaagtcacaacaacacatggtgctagagaagagagtgaatttgaatgcattttactgatgaggaatagagactcagagatgtttattgctgtacccaaggacccctggctagtatgaaatgccacaatcacatctgaccccacacacatattacagaagtggttaaggaaacatgaaacaaacgtggcgaaagaaataaatagtgggaagacctactaaacctaactatggacaataatctattgcatactaatttgtgggaagcaagagcagcagtgagtattaaaagcatgtatagagcattccatccagggaggccagggtaaacatagtgtcaagtcctgaaagagaaggcacaccacattgattcaggctacaagtgattctgatccattcgaaggaggtgtatgtgtccagaatgtttattgtaaaaatatcttcttcaagaagttgaacttaacactcaacagccagcactaacagctcaaagtgagcctggactttgattctacatgtccatacaccctagaagtggacacctccgtaaaattgactgtttagtgcactggttatagctactcattcatacttataatcacatcattatcattctgacaatgcacatattaacaaattcatattatcttaacttaaaatgtcccaaaatagaaggaactattctcacattaccttatttaggggaagaagaaaaacaactttctaaattagctcccttttttattaaacaagtctttaaaagcctaacgtttctctttatttcttgggaaatctgtctgacaagaattatcctattcacccattacacattttccaaacctggagcagatcccctgtggttgcaccacagaagagtacaggaagacacatcagatacaaatctctttgtccaagaatgctagaaaaaatccctaggcatgaagtctgcaagttgcataaaaatacctgaaaatggcctggcatggtggctcacatctgtaatcccagcactttgggaggccgagatgggcggatcacctgaggtcaggagttccagaccagcctggccaacatgatgaaaccccgtctctactaaaaacacaaaaattagctgggcatggtggtgggtgcctgtggtccctgctacttgggaggctggggcaggagaatcacttgaacccaggaggcattgcaatgagctgagatcacgccactgcactctagcctgggcgacaagagtgaaactccatctaaaaaaaaacaaaaaaaaaccctgaaattttggtctgtaggacctaataaacaggcaacattgcatgtattctcgctctggtcaggtaggttatgtatgactcttacccagtcataggctgtgtgccacataagactttgaattttgtctttagcttaatgcactgcatcttttttttttctttaatcaggcttactgctttagatttagattaatcttaatttaattaatgtatattttcttataagagaaaaaaatgcccagaagaaaagcaagatggatgaatcagtgtgtgtagatcagtatgtgtacacatagccagtaaaagatcatattttggaatccaaacacaggaaagattgaatactaaataaaggaattattttagaattcctttagaattacaggtgtgaggtggctcacacctgtaatcccagctctttgggaggccaagacgggtggattgcttgaggtcaagaattcaagaccagtctgaccaacatggtgaaacctcatctctactaaaaatacaaaaattagctggtcgtgatggcgggcacctgtaatcccagctactcgggagggtgaagtaggagaatcacttcaacctgggaggcagaggttgcagttagctgagatcgtgccactgcactccaacatgggtaacagcgcgagactctgtctcaaaaaataataataataataataataaagaatttaaaaatctcatttaaaatgtaatcattgtaataattgtggtatatgacagtatgctccaccagtccttaaatgactgaatagtgatgtcatgagcatcccaacagagcagcaaaaagaaggtaatgatgtctggattcgtttgctcaggctaccataacaaactattgtcaaccaggtggcttaaaacaacataaatgtattgtctcagggttcaggacactagaagtctgaaattaaggtgtcggcagggtcatactccctctgagagctctcagggaagatctgttcaagttctctccccttgctactagtaattctttggtgtatggcagcataactccagccttcacatgcactctctatttatagcaatgatcctgtgtacatgtctgtgtccaaattcttcctttttataaggacatgcatcatattgaattaagggcccaccctactctaatatgatctgatcctaactagttacatctgcaaagacccaatttcaaaataaggtcacattctgaagtactgggggttagaaattcaacacaggaattttgggggagcacaagtcaacccatgtgggtactcgacagcagtctcatatgtaatgcctaaattaggattgttcttgatattaacggtttgcataacttggctacttacagctgtttaaaactcttaaactgctattgtggaatataatacatagtaattatcccatttcttaatgcacgtaaaggaaagagtgatccagcatatgaagaggcaagaagtgtttctcagtcattgtggtttattcaagttaatacatctacaatctacatatatgtatagaagttgataaatatatagtttcactacatgttacatatacacattagtaatatataatccaaatttcctaaagatcacaccatatggcagatgtattagtgagatagcctcagcatagggccaccacaaaatctgttgtctgacctgaacagttttgagagtgaaagggcactattaacaattaggctagactacaggcaaaaaccagaggattcacagatctccaggaacaagggaaatttacccctggacatttgactgtacattacataattacacttcctgctttaccaagcactaaatttaacagcttaatttagaaaataatttgaactacccaatttacctgttttaatagcatactcgttatcaggaattaatgaataaaactcactgatgtgacaaaactttagcaaaatgcaaacaccacatcaggattatgagaatcagccagaattggacaccactggccacggaaacatgtatcatgggtcaatttactatgcagattcaactagatatctgcattaaagtaaaaccttagatcagtggttttcaacccagggtgattttgcccctcacatccaacatgacagtaaacaaaggggaagagccgaattcaaataaaatgatagtaggtatagaatacacgtttaccaaatttgtctgtagtaggaaaggtaaaggcaaagatccttctgcccatttataaatattgagtacctataaaaagggggagatcagtgtgtgaaaaatgcattagattttgcatatagtgagaatgtaacatatttacgttttgtaaataaaatgacatacaaaaaaagtattatggagaggacaatattaaaaggagacactaaccacatcaacatgagtctttctagtctttcctaagacaatgtattagactgttctcaagctgctataaagaactgcccaggactgggtaatttataaaggaaagaggtttaattaactcacagttccacagggccaggaggcctcagaaaacttacaatcatggtggaaatggaatcaaacacatccttcttcacatggcagcaggagagagaaatgagtgcccagcaaaggaggaagttccttataaaaccatcaaatctcatgagaacgaactgagtatcattagaataggatgggagaaaccagccccctgattcaattatctccacctggtcccccctaccacaacacatggggattatgggaactacaattcaagatgagatttgggtggggacacagccaaaccatattagacaataagagtagaatgcatctgaaatatttaagagcctcattaatgccaatcaactaaagaagttaaatattgtattatttcttctttgtagaaagaagaaaaagaagcagagatactactttttgatagaataaagcaaaagatattactttttgatagaataaagcaaaaataaataaataaataaagtaacagagattctgggcttccattttccctcatgtaatagcattccctcctcaccaatgtagacagtgaccactgggatttctgtttctataatacaccactttgtggtgtcattcttgtaagtgcactgtcctataagacaacaagcattatccatttacagaaaaagtagaccaacagaaacacctggtattcttttcatactcaccaagatgtttttggtgtatcagagttcaggccagccctataaaatttcagagccacatataagactaaacattaggctgggcacggtggctcacgcctgtaatcccagcactttgggaggccgaggcaggcggatcacgaggtcaggagatcgagatcacggtgaaaccccgtctctactaaaaatacaaaaaaaaaattagctgggcgcggtggcgggcacctgtagtcccagctacttgggaggctgaggcaggagaatggcgtgaacccgagaggcggagcttgcagtgagccgagctcgcgccactgcactccaaccagggtgacagagcaagactccatctcaaaaaaaaaaaaaaagactaaacattacatgcctaaaagtaaagcgtcacactgtcatgagcctgtccccaaagtaattttactgttttggggtctctgtaattgtacctctctgaaaaaagccaagcactttcagccaagaaaaaaaaatcttcattagtttactatgcagctttcccaggtgaaacaaatacccttagcaagagtgtgtgtccatgttaattacagcttgcccacaggccaccctggcaactgtccagccttcctgatatctacaaagcattttatgcactatgcacatgggcaggatagatagcctaatttccgctccagacccagcaggaaagaacagacactagtacctttctgctaaagacatgtttcactgcaaaattttccttcaggaaattcacagatctccaggaacaagggaaatttacccctggacatttgactgtacattacataattacacttcctgctttaccaagcactaaatttaacagcttaatttagaaaataatttgaactacccaatttacctgttttaatagcatattcgttattgggaattaatgaataaaactcactgatgtgacaaaactttagcaaaatgcaaacaccacatcaggattatgagaatcagccagaattggacaccactggccacggaaacatgtatcatgggtcaatttactatgcagattcaactagatatctgcattaaagtaaaaccttagatcagtggttttcaaccccgggtgattttgcccctcaggagacatctgatgatatctggtgacattttttattgtcatgacttgaggagggattgcttactggcatttactatgtagagagaggccaaggacgctgctaaaatcctacattgcacaggacagcgccccccgcccttccacttcaaagaactgtctgatccaaaatgtcaatagtcctgaggttgagaaattctgccttaggttatgtgagaaaaattagtggttttgcattaattgtgtgttaatactatgttccatagatgcattttaatagacattaatagttatgttcagtcaagtttctctgatacgattctcctaccttgtcaaaattatgaattgtcaccaaatactacacaatgaagtacaaacaagttctataaaattaaaataaaatagtctaacattcatcatgctgtgtctgaatttaggagagatgaaggactggtcagaaatataaatgaccagcattcctgatattttcctggcatctacaaaatgcaaaactaaattacatgtaatgttaattgaggattccaaagatcttttaatttccagttttcatgcattaccaactcatgattttttttccacccttaaatatgaaacttgcactgcttttaacctaccacattaccaaggtcagaaacagaaccactctcattgtcagataaaagcatgagaaaagtattcacaaatgtacttaactagacataaggtggaaatccagttctgtctcttataaaatgctaaaaatcttctctatgatacactttaaaaggaataattgctttaaatgttttgaagtccttgccgcattatttataaacaacaactttgcagagtacttgcctgtgataaatttgtattatgttttacgtggatcaaatttttgaccttcaattcagaatgacaaaaaatagaaaaatcatagcgagcaggaaaaaaaaaaaaataaggccacacctttctctaacattggttgttattatttagtcctttatggataacacataaccatcttttacacttcttcaagtccatatccttcaaaacatctttattcttcttatcctaatgttccatccctcaatctaacacacgggtattcaggtatctacaattttattaaaaagcccttgtgctttattattacaaaatacaacatacagggcagttttttcctgaccatgctcagcttatcagaactactttattatgcaccactgatctctatttaaaatgatgactttgttttataacagaatctaatgttctaaggagacagtttctgatgttagaaaggggaaaacctcaggaagcattctttcaaaacctgctccatgactttatgccaagacattggtaagcaaactttcagaagcagatatcccagaagctcctcttctgaaacagtgtttgacagtagcaatcacaagtcagaacagaactacgaaataattaccttttaaaaaatacagtctgcatttaaatggtctacacagcagagatttatctgtgctaataaactctctttaaaatgacatcactaggaagattctgcttatccaatggtttgagacagaagggttcctttgaattttagaggggagagggctcaaatcatgggtgatacataaaaacaagaatttgaatttgatcaatcaaggaagagcgtttgggcactgatactccaaaaaagaataaacatcatgggagaagggcagggaaagagaggcagatgaatacaaagccacatttcatcacagttgatgattgcctcctgcactatgaagaatgcttatatccctttcaaggtgcttacctccatacagggcttgctcagaactcatcagaccacagatgcgccttaattcaccatctcattgcaaatgaggatggtcagggaagataaagagaaacacacagaatcttatttcaggactatctgaagtctacagaatgatcttacagataatttggaatcaacaattctggtctccaaaaatttcccatgatgcaataaatgttttggtggtttcatccatttatattccttaaacatacttcgtcttttattccatggatccttgagaaaaggcctaaccatcccctaagtgaagctgttcacaaagaagagaatacttaatttttaaatgtgaggtttatgaggcaacatctggctttaaatgcccatcccatatttttacccaaatggcaaataaagtaattaaaatattcatgtttaagggtcatcttgccaagatacattaaatgatgtgcacataaaatgtaataataattaatatcttactgcaataattaactataatggtcaccaaggtgttggacaatttctattggtaagatttcagcagctatctcttagaatcatggcctctgaattctctttcttgaagattttcatccttgatgaataacctccatgatgttatttataaggaaatttatcaataacgtatttgttgtgagctttatccagaaaatcacttaaaagggaaaagctactctaggaagtttagcaagagtatgtctagcactatttatattggtattcttcttgacctgacattgtaactattatctgggagatgcagcatctttgtaaaaagatctagttcaattcaattcgttttaagtgacctactggaaagcagaataaggacccctcaagagagtcttgaaacacataactctgattttctaggaaactagtttatctcaacagtctggaaaaactccatagaagttcttgagacagctgttccggaagaagtgtatagtgacagatataatgtagtaaggactgcatggaaaggcatttaaaaaaatagataaccttgtactagtcttttgatataatttatgccttggtttcattaggtaaaatcctacgtgcaacacagaacatcattggcaacaggctgtcagaaaaatctccaatagaacagaaaataagcaaaagatgctttgtcaagaaaaaaaaaaaatttccatgcattttaattccagtgtgcacagatgcctggaaagaaactaaggtccacaaaatgaaaaagctctgcaattctcactatttgctaactgaacatctgaaccaaacttaaatgacacactccattccttgaaaacttttaattgccttttgcaagaatatattgtttaattctggatgtgtttcaatacagggagaattatttatacttttgtactttcgcagacactctgagatctgagttatcaatggagacttttatatagcctcagccccataggccaaatatattttaaacagatatatatatatacatatatatacactttctttaacgtagagagaactcaacctgccccaggcatgcattaatgtttttatcttcattcttggaaataaaatctttgtggattaacaattttacatacatctgcttcttgactatatacaaataatctcagaagccatcaaaagggaatagctaccttcagattagctgatttactgaaactatgaacaaagagtatgcagtcctccttttcactgcagtatcaaaatagttggtttgctgaaagcaagtgtttgaattcatggcaaatagtaaatgttctaaagagaacacattaaaagccaaatttgcttatgagcaacaaaattctggcaaggaactacagagcttgtagttcctcgtcaaatagcaggcttccttcaaaccaaagcattacgattactttgaggaaaaggccattgcgatccatagctaaaatagaaagtaagtgttaaagtagagcctatcactttcatgtaaaatcatttaatgtgaaaatcttctattgtagtttttgtaacgccattttcaaactgaaaacggtaatttagttatgtcctaaatactcaaagtaaactagagctattcagattatgctactctgaggctgctaatctgggaactgtgtctaccagtccacaagaaaagtgcacaaactgggagtgtttacacacttttaaaacagtttggaaagagtaattttatggctgtggaatttaagtaaaagaaggtttataatatgtatatctttttaaatttcatttttctattaattgattttcattccatttcacaaaaatatacctttgcaatggatataaaatttacaaaataaataaatcagccctacccctttagcacagttagtgtgaaaagcactaaattagacacttactctgaccagtgttccctggtgctagcaaattaattattgctagacttataacaagaaaaatcctgaacaaatcagacaaccagcagcactctgaaaataaaatgacttaggacatgcacaggctgagcagggaagcacctgtatggagtatatgaaggacctactttttaaaggaaatttactgagcacccagtacataagcagtattaaaaagcacgtcatcgttatttttttctttgaaaaacagaactcatagctattcacctaaatctactcactgaaatgaagaaatcattaatactttataactggggcgttagaggacattaccattacatactgattcaaatgaaaaatcagatgttgtttaggactgtagagtattggctagtttatgcaggcaaataaatggatatttttcaggaaagacccaagtataaaccttaatttggaaggatcataatcctttacatttcaaaagaattgttttataatttttctacatatttattgacaataatggtataaattggcttaaaccatagcaaagagaattcttctttgcagaaagtgaaaagttcagctaactaatgatgacagcacccttaatgactagttaatgagctactggagtttactttccttataggatggatcagaactaatgtgacccaacacagtttgcctgaaggcaaaagagtgatgggtcatctgatgcttcacagcatttcccaaatctgtgagcacgtaaagtaggaaagaaatgagcattcacatcttttagtttttggtgtatttgtgattgctgtctaatataacacttgtggtaggcaggattctgagatgattctcataattcccactcctgcagaacccattctccttgagtgtgagtggggaccatgatatgaagggatgtcactcccttaattatgtgacgttatgtggtaaaggtaacacgattctgcagatggaattccgatctcacatcacttgattttcaatgaatcaaaaaagggagtataatgaatgatctaacttaatcagctgaatgcccttcaaaggggtattgagccccctttctgaatgaagagagtttccctctagtctacaagaaataaactgccatgttgtaagaggacctttaatagggcctcaacaaccacacgattttgaaagaggagcaggaagtagccccatacgggaatgcagtccaggcaacaccttactgcagccttgtgagactgaacaaggggccaccacgactcctcagcattgaaactgttagataataaatgtatattgttttaaaccattcagtttgtggcagtatgctacacagaatagaaaataccaaaccaaaataaataaataaataaatttacattaccaaattttaaacatgagattcaatttttttttttttttttaagagacagagtcttgctctgttgccgaggctggagtgcggctgctggatcatagctcactgcagccccaacgttcaggctcaagtgatcctctcacccgcatagctgggactaataggtgcatgccagcacacccagacaattatttaattttcagtaaagggaggtctcaaactcatcctcccgcctcagcctcccaaattgctgggattacaagtgtgagccaccgcgcccaacccaggattcattttatctttgcataaaatgcctttatgaaaattctgtttggggctgggcgtggtggctcactcctgtaatccctgcaatttgggaggctgaggcaggtggatcacctgaggtcgggagttcaaaaccagcctagccaagatggcgaaaccccgtctcttactaaaaatacaaaaattagccgagcatggtggcacatgcctgtaatcccagctagtagggaggctgaggcacgagaatccactcaaacctgggaggcggaggctgcaatgagccaagattgcaccactgcactccagcctgggtgacagagcgagactctgcttcaaaaatatataaataaataaataaataaataaataaataaataaataaatacataaattctatttggtttgtttagattcactgaaccttaaattagtcatcagtctttgatttcctctgtataatctgattcacatcttttttgtatccacgttgaggatctaacatgtatttctaactcttctcatttattcatgcctctacactaggaggaaaactcatcaactggcacaataaacggccgcacataaaagactgcacacacccctcttctatactttaaaatgccttatgagctcagatacaaattcttgaaaaattagaattgatactttaaacagcataatgtaattgatttttacttttctgaaaatatttcataatatacatttattactcaaggtaaaccatgatgatatgtgtgttgctcatcttagcaggaaaaaaaagtgccattctatattacaagtagtatggtaattattgcttatgtatctttaacgttacaattttccgtttgcaaagattactagaactaatattgtcaagggagaacacctagggcctctttcacagaactaaaatcatcagggacaatgggccactaaaattatttttctgcacacaaggccaatttttctgaaaggtcaatgacttcattatatactacaatatacccccctacccttattcaaggttttgctctctctctttctggggtttcagttacccgcagtcgaccaaagtccaaaagtgctacagaattagagagggagagagaccacctccacacaacttttattacagtgtattgttataactgttccattttattagttgttttaatcacctttctgtgcctaatttataaactgtatcataggtaatgtatacataggcaaaaacatagtatatatttttaatcagtaatatacgcagtttcaggcatccactggggggtctggaaatgtgtccctagtggataagggggaacttatctgtacttgataagtccttcaatcagatacaaaaagaagcttggtgccatactatgccttagcacaatttggatggtagcaaaatgtttaaaagagaggaaaacatcaaacttcatgatttttgctttcagaaaggagaaacttaaaacagtgggaaaataaacttttcaggagcataaccacaagcatgggagtgctcaagtaccaagaaagatctaatttatggtcaatagatacatgaatgacaattctgtaacaactaaaaccaagtttttaagaaataggaggtgagcaattatgtgttggatagtgctaaagccagaaattcttccttacaagatgttacgaaggtaggtcttacatctagttaatggtggaagcaaacaggaacccatgtcacctgattagactgttatcctgcttctaatcagagtatatttgttcagtgctttctacatgcagtgttttacatgaatatttttaatccttacaagaaccctatgaagttttatcaatgggaaggttgacttgttcaagttacccagctagttgtagagctgagctttgaatctgcacttttaaccaaccatgcaagttccatgaaataattaaactctgatgttcaaaagcatcaattttttaatgcaatgacttctcttctatgccattaatatggtactagttatgaaccattttgaggagaattaaaaagtcactcaaatgaatatctgtcctctgtttcagatgaggaaacctgattagaaaggcagcaacccaaggccagatgcaatggctcacgcctgtattcccagcactttgggaggctgaagcaggaggatcacctgaggtcaggagtttgagacgagcctggccaacatagtgagataccaagactccgtctctccaaaatatttttttaaaactagctaggcatggacaacagagcaagatcttgtctttaaaaaaataaaaaataaataaaaaaaaaacaaacaaaaaacagaaaggctgcaaccacaccatatatgatcactttttagaattgtaattacttgatagtcacatacaagaatgaagctttaatgatattcagcatagatccaacatctaaatccatttaaattataggagacctgtgtaacttgacaggaatctgtactgatttagtgaacagaaaggatatggagcaaacagccatcttcagcttcagacaaaagccatgacacaagcataaaaaatcttaaacataacctcaggacgataagcaaggaaccatctgttgcattttatttatttattttatgacttggacctccctttcccactcccattccagagattttcccctagtgttctaatcagataaatgtgaaaagcataagagaaaacagtagtctttactaatctccatagatgcctccaggagtagattagaaaatcaagaaaaatgtctagttctcatggctccacattagaatcagaaaagatgaaagaactaacacttttcaccctttgctcaataaattcagtggaatatacatagacaagtacttgatggcctctcatttaagccttaccatttcccctaaaaggtccggtatgtgatactcttttacagaatatgaaatgaaactgaaagaaaattaactttccaagatcacacaggctataccagaagcagggttcaaccttgggattctctgactcaaaatcctgaatattcccaccataccagattgcctaccttgagtcctctgaactaccatagcatagactcatatggttctggctttacttaagtatctatcaacttagcaatttttgggagttagtagagcaatacagaaccactgtgggtttgaagatgtgaaagagtaggatcacaggattccgactggacaaaaaagtaaaataatcagcagttatatatcacatccactttgatgtttcagttactcctaataaatttacaatcttttccatggatgatggcatttctggatactacaaagcattttcaggttttataatgttttctaaatgtatatattctatgtacatgtagcatatctgaatctgcatgtatattttcttcatatcttataactttcacttgatataaatcattataatatatatttgatgtttattgtgtaatgtgtattatatgtatgcacacatcatataaatatgtacatatctgtgtatgtgactgatgtatgtgtttctctgcaattagggtagatatatagaggcaacagaaggaagaaggaaaaaaaaatcgattctgagtagcctgctgaccccaggttttggctccctgtgcatattacaagaatagagtccaggagccaatttacttcacatgtggaaaaacccaaaagcggtaggaccaaatccaagacttgcaaccttcaaatggctcctctgtcacagtcatgtacagccgggactcagctggcctttagatgccacacagacaggttgtgtcacatctgataagttaaggagatgaatgacctcatataattatcacgcatgatttggtctgtgatgagttaccattcccctatgtttattcattaccatcgagcaaaaatataaattttaaacaattactcaccaatagaccttgacacccatgtatcaatcctctgggaactaagctacccattcacaataaaattttgcctcataaaaattaatgccaatttctacacttatatcgacaggaaaatcaggtgtttggactgacagccaagcagctaatatgtttaatttagagcagtctgcacagcctccattgtgcccatcttcctgaggcttcatatggcccatttgtttaagtcccccaacatttttgcagatgtaaatttaagtcaattctaataaaatgtcatgacaaagacagggtggtatttttaaagtgacaaacttcataaaaattttacacattcttttctatggcaaatgtcaaaatgactgctataaaaaggccatgttggctgggcgcagtggctcacacctgtagtaatcctaacactttgggaagccgaggcaggcagatcacctgaggtcaggagcccgagaccagcctggccaatatggtgaaccccgtctctactcagaatataaaaaaattagccaggcatggtggttggcacctgtaatcccagctactcaggaggctgaggcaggagaattgcttgaacccaggaggcggaggttgcagtgagctaagatcaggcagttgcactccagcctgggtgatagagacagactccatctcaaaaaaaaaaaaaaaccagattcctggcattgaaagcttgctgcttcaatggttatcatcaagttgtaatcattaatcattagtcatggtattaatgtattggttaatctaaaacatcttttatccataaatcaactccaaatttgcaccagaaattttatttcagtgtttgatttctaccaacaagagaacagtgtttatgagaggctcaactccatttatattgcaaagtgaagggctggagttagatgagtgtaactaaccatcagctggatgagtcaagtaaacgctggcctttttcagtacgctcttggcagatttttgccaacttctgtattggttgcgaaaaacgcaactggtcttgattttactatcctgcacttgctcaatttgtagggtagtctggaatcatttctataaacatcctggatagattgcattattaactttcagatattctgttttggggctaaaaactcacatctttgacaatgagaggatattggtggtaaagctatgacttttaaaaatagattcactctctgtggcacagttctcctacaacaggtgctgactgaaatgtcacaacaaagcacatcaaatgctttgtggttctgctttcttcacggtctcttttaggacactggttttgtccttaacctagggatggaacagttcacccaccctattccacttacactccaccgcatctctttccctttcccttttatgatgaaagactgcacaggttttaggaggagacatttttaagacctgctaagcatccctttttccattcattttaagtttttctcatggcccaaatggttatatattagcacaataatctagctcactaatccatagtcatcaattcgtgatctcttaaaggcagaaaaaccacataaggcacacataatgaagcctggctattaaacagtccttcaaagttccccacgcattctttcatttaatcctcacgataacattggatgcaggaagcaaaaatactatctttgttctacagatggagaaatcaaggctgagagttagttatgttctactttacatgactcctctctctcaatcttattgctggaatatgcagccaggcgagataatagatgctaagacctcaaagcttctgcaaagggcagcaaagttcagcaggtaagtgtaggaatctagaattgagctgcttgagatcaaatctgaactcctaaggaaattcaaaaaagttcttcataccctaaacttgttcccgcatttacaaaacaaagataataataatacttatctccgaggattgccttgaaggttagatggattaaaaaacatgaggccaggcgcagtggctcacgcctgtaaccccagcactttggaggttgaggtgggtggattactgaggtcaggtgttggagaccagcctggccaacatggtgaaaccctatctctactaaaaatacaaaaattagccgggcatggtggcacgcacctgtaatcccagctactagggaggctgaggcaggagaatcacttgaacccaggaggtggaggttgcagtgagccgagatcacgccactccactccagcctgggcaacagaacaagactctgtcttaaaaaaaaaaaaaaaaaaaaattggagagtactaattaatagtgcctggcatacagaaggagctcaaaaatgtcagaaaacaatattattgtaattgaagaatgattgttagtaattattactgttcagacactgcaggtggagacaccaaaattagttcaaactgtgaatatctatgggagagaaaaaagagcaaagtcacaaaagggaaataaatagcccaccctaactcttcttatctcttgccacaaaccgcaagcatggtttttccacactgcaatggtaccaatgagatgaagactgattcttagatccactggcatttgcaatcctaaccattcattcattcatcttggaaactcaggaactgccgtgatggcaagtgccagtaatttccagaccttcaagagacctgggatgcctcagtgaggtttaaccaaggatatgctttgcagggatattctgtcagttttttgtttgtttatttgtttagagatgagcctatgttgcccaggcaagatttgaactcctgggctcaagcgatcttcctgcctcagcctccccaacagctgagcctacaagcgagccctcgcccaaattccagtggttttttaatcttctagagtttactgttttcttttcttgacaaggatctgtttcgaccaaaacttctcccttctactgggggcaggaagcaccaatagagtggggcagtaaaccactactatctgcttaaaattaatgaataagtaatgctcaattgccaaaggaaagaactatttgttcttttatctgtttctttttcaatgatattactggaagatctttctaccacaagcaccacacacttaaaatctaatgacatcggctgggtgtcgcggctcacgcctgtaatcctagcactttgggaggccaaggcaggtggattgcttgaggtcaggagttcgagaccagcctgaccaatatggtgaagccccatctctactaaatatacaaaaaagttagccgggtgtggtggcgtgcgcctgtagtcccagctactcaggaggctgagacaaaaaaatcacttgaagccggaaggcagagattgcagtgagctgagatcacaccactgcactccagcctgagtgacacagtgagactccatctcaaaaaaaaaaaaaaattctaacgacatgttataaaactacatgaatctttaagatgataatctctcctaggaaagaagtaaatgaaaaataaagacaagtgagaaccaaatgttgctgtgtccaaaggtaatatagtggcaaactggagtcttgttactaccactgaaagaaaaactctagtccattcctctcaaaatttgaatattactaatgtgtatgtattacatttctgaattatgtcattccttcttgagaatggaatatgtaatttaaatcattcctctaaaaacatctccagtaaattaaaattatatctatcctgtattccaaccatctgctttaattctcaaggctgtttcatatttcaaaagttactttgtaagacattgtgtttagtcttgatcccttcctcacctgcctctatcagaacattcatccatcaatcatggcatctcattgctttcatctctctgacatttggtcttctccctctgagatactggaatctcccttctggtaacactatttagttgtctgtacagccttccacaccttccccacccttctcaccagagcctttttctgagaatcggctcttcccctatccagggtaatagcaactggccttttaccatgtaatacctcctaagaagactggaccagatatggtgaactaacccaagctcaggcaaccagagtctcttttccaaatcccatctcctggtcacaattaaatggactgtaagtggccatctggcccacattcagactgtcaacacatcttctttgggaggttatctttaggactagaattctacactcaagctggttcaaggcttcaaaggagaaagcataatccctcgcaaccattcaacaccatgagcactggaggcagataatgccaatttatagagaaagagaagaaagaagtgacacaaagaaaagcagaaaatgacttgagagattatcatgatagcagtctcacctttttctgcagttgttggaacatccttgacctgaactcccatgatggatcatccagctccactaccatttaaaaatatttctctttttggtttaagatagtcctatggttttgtacaatctacaatcccaaacggcctaatattaacttactatttattgttttttcttaacttttatttttaagttgaggggtaaaagtggaggtatgtaacataggtaaacttgtgtcataggggtttgttgtacagatgatttcatcagccaggcattaagtctacttaattagttattaattaagtacttaattaagtactcattagttattttttctgatcctctcactcctcccactctccaccctctgaaaggtcccagtgtgtgttgatcccctctatgtgtccacgtgttctcattatgttgttccactttataagtgagaacatgcagtatttggttttctgttcctgtgttagtttgctaaggataatgtcttcctctgaatttactctattatctctcactttcctcatgtcaccgaattcctggaagaaacaatctgcacttgtctccatattctcaacttgaccaactcctcaagccactgaaaccatgcttctgtccctgacacgctacttagacttctttctttcatcagtggcctgatgacttcctttaaggggtcatctagtttgacctctccacaaaatgaaactgtaaatcaaggcccttcttttgaaactcagtgtctatcttagtagattatagataaatatgagttaaataaatgaaaaaaatccttcttctgccttcaaaagtattgctctctgaatttgtctccaaactctcttcagatactttttttttttttttttttttttgagacggagtctcactctgtcacccaggctggaatgcagtggcacaatcttggctcactgcaacatccgcctcccgggttcaagtgattcccctgcctcagcctcctcagcagctgggactacaggcgcatgccatcacacccggctaattttttgtatttttagtagagatggggtttcaccgtgttagccaggattgtctcgatctctcctgacctcatgatctgcccacctcggcctcccaaagtgctgggattacaggtgtgagccaccatgcccggcccagatacatatttctaagggcctaacagacatctaaaagacactgcaaactccaaatgtccaacgatcaacctactcccactctcacaacatcaacctgcattcctcctgtgttctctagcctacaaaatttaatgacacatgatctacatgttagagatctaaaagtcatctccaattcttcttcctttcctgattccccaaatctcacaaccaccaagtcctgaaattgtacttctacttcatacctgcttcaccttctcactgccactaatctttttgaaacctcgggcatcatctctggttcagtgaatgctgcaatggtatactaactagtctcattgcctctgcctaatatactggcccgccttaatccatcttctacatattatgattcaaacctattactttttttttttaatttaaaaatctcaacagcaacacaggatagaagaccaaatttgtgttggtacaccaaacagggctattgcaaatgtcgatgtaatatgagcactgctcatcccctccttgggtcaggatgcaagaaatttataaccagacttaagccaatagctaccaacatcacttccaattgacaagtccaatgcctaacaaagaacagaccacgtttctttagaccatgccccttcagtatgcaatgtactttttccttggtcatgctctgatgtatcccagtgttccatagtcagcttggagttgctaatgttttccttagggactctcttccctcagtttgtattctcaacatgtagctcagcgcagtacgtaatttgcactgaataataatcatcatcacgttaattgttgaattaaattatatttggtgttaaaaaatatttgaaacaagaaatatttaaaaaggcaatataaattaaaacaacttcaaaaataaaatgtactatttatttagaagcctagttttaagtatactacctagaaggctgcttacctgcaagttatttctttcttgtaatctaatgaaaaaaattttctaacagaatttctttcttgttgattagcacttaagctcttaattaaatgttatactagtgtttcttatccaataaaccatttcccagaatttcataaaaactaagaatttttaagtacttatgttctgagatctagataattttattgtctttggtctctaaggtgaatttccaaatgtgaatatttaagtctctaaaaatgattattatgtttaggaagcagcatttccaatataaccaagctcatatgggaaatgaagaaaacagaagcattaagaaaaataaccaactgctacctttagtatctttaatgtaattttgcacctcataaatctgagggctcttctctctgccccacttacacatccatcactcctcagagtattttcaccacaatgcctgttgctcactttttaaaaacaagagatttttgcagtctgcctgagcccatttatttcattgcaccatccctcttgtaactctcaaaatatggcattattaatatttaaccatcccttcacatagtttgacagtatgcaccttagaaaaattttattagctctttcccctcttttccctaattatccctaaggtattgggcaaatatcaaaagaaacaattctctagacttgcttgacaactttggtatgtgttgattacatattacaggtttatctgtatatcaaaatccctcaacaatttctcttagagagaaatgtctggtgataacaggaaatctgaaacagggagcacagattgaagtgaaaaggacctgaaattgaggtctgatcatgggtaacttaagagaaacacattttaaaatttttcatttgatttgatgttatatacaaataataatgttatggttaatagtaattatatgcatgtgtatgaaagagagagaaaccagaatttattatttgaataaaataacattggaattgctttccatcatttgccagaagaccaccatagcgtatttttaattacacagaaaaaaagagcttcaaatagacagtaagattatccccaaatctgaagcatttaaaatggccagcaccattattttctactgccaccagttcaagtttttcttccatttatgatacagaattttaaatgtatcctaattttttaaatccacagagcatatggttaaaaaaaatcagcagaagcaaatgttaaaataacatttagccagaaatatcccacattcatattcaaagagaacttcaaatattgctttatatataacagcctaattctgaattattgaaattaactataaaaagtgtgccggtttgttgaggccacaaagtcaatcttttcctcgttcataacctgtacaaacaagtggcaaaatataaaggagcaatgaccgctttctttactcatttttaaaaactgctaagagtagctgattctatgtactgaattactacaaaagatgtaaagcctacaaagaagggatatttaagagcttatattttacaaataaaaattttaaacctgtgcacatttgccttcattcctaaaatatcacaccaccaaatatgtttaattctaaatttcaaagtatatcttatctaaatgaaagaaataaaactgcttagtatgtaaagaacttttaataggtgccaacatttcaaatggtatagtttctttctcacacttgtttaaaagacagcaaaactgtctttagaatcacttttttaattacttgtcaattatgttagtaacccgtctctataggacttgagcattttcaggctgcttgtgtatgcaatatctcatttaattgtcttggcaaatcattcttaaatgctggtgttattaagttagatttaatccctgaaaacagttgtggactgacagaagacctaaggtatgcacacttgttaataaacttaccttactgaggtttttctactctgtcaatccacttaaagttttaaaaatatgtatggacatacacacgtatatatgtgtatttgcatatacataaaatactatctattaaatagaatactatatagtgacacaaactaggaaagttatctaattatacgatgttaatattttggactctcaaggaaaaggtagtaacatagtattttttcacaaagtgctgccacttttacttaattgacattgaggtcaattgcctttttctttcaactctgtaaacaacactacgcaatcgtttacatgtttcagtgcacatacaaaaaaatgaatcctgtgtaagctacatggttggccatcacagcccattcctagtttactggaaagcaactgtatgaaagccttgggaacagtcgtggtactgctcacagatagttcatgaaaagaaagactggttgacacagttagtgacacagtgcttgatgcacactgtaagccttaagtaaatgtggaggcgatataatagaacaaagtttgttccccatggaaagcagctgacctgctttttgaaacactaccacagacagctcttttaatagaaataatggaccgttgtcattttaataacaataaaatgttacttttttgaaatactgaaattctgatttttttcccaaaatgttatgtatacttacgttagaaatgcttatgtccatacatataagacattaaatgagatcaacaaattgcatgatttgcctaagatatgtttcattttacccatttaaatctccaatttaaagttataaatagcttgaagacatgtgctaggaaattcttggaaacttgcatctatattgagaaatagggaaatcaagagaaaccttaagaggtgctttatataatgatactccagagaatatgtaaattatatagtttgttatgagcactattgtaaaaattatttgtaaaatttctcaatgcattattgtttatgaatatatactcctatatatactaaattttagcacaataataatttccatatgttatgtttttgtaaaaatttactatgtgtaaaccctagaaagaagagtattttattgttagttttatcaatgttggagaaataacagaaagatgtctacacagtcagtttgttgtgaagaaaacaactgtaaagctcttatctattgtcaaaatgaaccacctactttatattcaaattttatgtatatttattaaattaaattaatgaaagccatgggagggggagataataaaggcacatttcatttccctttaataaaccataatatgcttagattcttgtattttcttacatttttttcaaaaattatatccatttcagtctgcttaattttcattcaaatgccaatccaaatagctacacatatagctatgtgtaacattaataaatttaacataatattactacttacgtggaaaaatatatctattgttgcatattttaaaacatacatctgtggaatagtaaatgttatatggttaagccgatgagaacaaaattaaagacttgagaaaagtttattaatgttcactgtttcaggttttattttacatttaatattttatctcataattgatcatatggcacatttccttgtgtatgtaaaatgtaaacagaaactgctgacttcaagtgagaataattatgtcacttataatgcatggaacagatatccattacaatatcctgacatacaaaatttctcctttatagccttaaatacaaatttctctaataacaggaaaaaaaaatatcctaagtaattaaagccaaaagtactatacttctatgagaatttatgcttatttcctgtggatatccacaattcttagttttatatttataccattgtacactttatattaaaatccctgtataccaataggctctcagccaattattgtagactgactggcattttgatgtgactgagataaaagtttgatattaacagttataactatatattttttaattgcatttgtaaatagattctaaaattaaggacaaatttaaattaccattataatactggctatcacacatgtaattctaaatattaaaatagaagtcttttaacatgtgacaagaaattatttctagaaaaacggacaactaccctttttgaaagctacattttaaaaataccaatacgacatgtgcatactatagcataaaaatgatatattttccatttatatatcaaccaatacacattatgtggctgctaccatatcatgtatttatgtttcacaccttagggagacaaacatttccaaaagaaacacctaacccagagaaataatcatatcaaaatttccttgtctgaaaaacatctattttagtgttaactcttagaacaggttaactactactttaatccaaaagaaaatttatattagaatgtatgttaaacaggagagcaaaaaatgaaagaagatacttaactgacacatcatttgttttaccataatagaatttaagcccttcacacaaatgtaaacactctatatttttaaaaaaaaactttgaactactaattctaattgaagtccaactccaattagtgcataattaattttatagtgtgtgatggcatgctcttcctcttcagctgataaaaacttcttacattactttttctgtgaaaaatgaaactggcaaaaaaaaaaacccaaaaatatttactaatgattccgagagaaatttacatacagaagcataataatttgcctttattgacactacagtctttgcactcagtttttataaatttgaaattttcccccaaagatttgagatttgtcctgattaaacagtgcatatgaattcttttctcgaaagaaaagcaaatggcacatctttatgaaaaatattgcattttttaatttcataaagtttattcagaaatctaacatgaagtacaaatgtcaaccatcagttctttcctcagaagacagtgttactaacttttcaaatgaaaaactgaagatgcagaaggcttccaaaaatattgttaagattacctacaggagattgacttcgctccacaaaaccttttattaagtatttcattcattaaataatcaatgtcttatataatttgaaaatatcttgaattttcatcgttaaaaaaaatttcagatccttccaaagaaaagaaattgtgatgtcctacttcccattttaacccactatatatactctttcttgtgtctagtaaatttctgaccatgaaaattgatttacttataattttaggaaagcattattgcagatgttcttcttaacaataaggatttttacattaatattttaccacagtatgttgaggaataaaaggttgtattttgttgtagttttccccaatggtatgatgatgtatcccctcccatgataaaaatattgataaattgtcagttaaaaacaacactgtaaaaatgagtaatcggaacacatttaggaagtgattgttttttaaagagccacttatttatttgacacagaatgcaagcgactcatttgagttctcactttacaggccaagcaacaaacagacttaaaaaattaaatggaagtgtgatgccttaataagagtaaataattctgaagcatccttagggtgattcttactctttttatgtttaaaaatatctgactggaacatcctgccaattaaacgaagatctccagatggcatttacccttttgcttcataacaaaaaggatctgcaatcagttttatggaagattatctaaagaggaacattactgtaactcaatgacaacaaaaattagacactccccttctccgggatagaatgtgcatcctccagattcttgcactgacacctaaggtaataaatacttaaaactgaatcttaaataatagccgcaggatttcaaccgctaaagattcactgttactttccaccaaaaactcctgtattcagcactcagccaacaaaggacagcaagtaattcccagcagcataaataccgggaaagctaccttgggctttgtttttgttatgtaaaatgcattaaagtgactcatccacttaagattacctacctttagaagctttaaagaagctccaagaaccaaaataaatgctttcccagaatgccggataggctattcggtgcattaaaaaatatgtatatatttatatgtgccattgagtttgattctattttgctaagaaaggagagaattattatttttcattcccttcctgtggtgtgactatagctacctataagccctctatttccagaacagcagcgaggtttttaaaagttattttagaaatggtaaaaataaaagaaaatttgtaggagactggaaatagtccctccttcaaagaataggctctattcatttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccccggccgctcgctccccacccccacgggcggaaaagccccgcgactcgggaaccgacccccacccccaactcccgcggcgcccctcggccggcgctccctgcccggcccgccgacttacgtgacggccgaagggaacggctcctccgacgaggggccgatgagcaaagattggaaaagtgtcagagtcaaggccagcaggcagccagcagccatcttcgcgatcgaagatcaatgccccctccctgcccaagcgggggaaggagcggcgctggaaaccgcgggcggaggaagagcagcacacgccgccgggaccgcgggcgtctggagggctggctgcgcccggggcccgaggcgcggagccgcgcgggggacggcaagggcgggagcggacgccgaggaaggggcggtggcgggcggacccactagcgtgcgtcggctgctccgcgccgcggccgccttgcctccgccg

SEQ ID NO: 815 - DNA, 246837 bp, Homo sapiens
ggcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggccatatcctgccgggcggggccgggcggggccgggcggggaccggggtgggggccggggccggggccatcttcccggtggccgggagggcgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggctccggacccagttgtctcagcccctccggagacggcctagcggtggctgctgcactgggctctgctggcgtcggcctcgtgtttccctccgtgcggcgtctgccggccagtccttaactcacgcactccattcgagtatatgatcctggccaccatcatcgccaactgcatcgtgctggccctggagcagcacctccctgatggggacaaaacgcccatgtccgagcggctggtgagtgcccggctgggcctgagggcagggtggtggggaggccgcgactccactttcctttatggtctgtgcctgagaacagcttcctcgggcagggtcgtctgggcagtgcccctcgcgtctgaaggaaaaggtaggcctggcagataacaccttcctcgagggccagggcagctggggtcaccggcttagccctgggcgtggccacgttagccctgggccagtctgccctgtgccacgagctactcctgcacctcaatggctgtcctggctttcggcgctagactttgatccagaaaaccatgttctaaacttggggtggggaaggggcattcatgtcttcgggaaggtcagctctgaatgccatgtgtgccctgctgggctgagatgggctttggcctggatgtgggaaccctgagcctcatcctccaagttgtcttgtgcgggcctgcttggaacctcttctccagtgggcctcaccatcctgtgggaagcattccttctcaaacattctgaatcatttttacctgtccccagattccagccaagaggcccccgtggtagcccccattggagcatagagtctgtgtgagtcagggtgccagggcaaggtctccgtggctcaacaggaggcaaggtggaaggccagccctgtggggtctctggaggggctgggtcagaggaagggcagcattttggaggtgagcagtttctgaggtcagagcatgtcccccagcccccactcttccctgatgcctggccccatgtctgggttccgagtgtgcctaaagactggagcctccaggtgagcagaaggcagagcaagtgggggcccagggggtgcggggccagaggcgtccaggagacggcctctctggggtgtcaggagctgctccctcttcccttaagcctggcttccgcccccactagcatcctgagacaagagctattcagactttagccctgaaactgaactccctttgaacctgggccaccgcaggcccaggagtgcagaaggggagacagggagcctgtcctggaggtgaggcaccaggaggtgagttatgggtggccgaggtgaggaggtcttaatggagcacagtctggaatgcccagtggtctgggttacggccgggtgaggaggaggagcatggacagcccagccacaccatgaggcaggcgtgagtcatggtccctgtgggggacttgggcaggaccctggtggggcccattgctttctggaggctggagaagagggtgagcttgagaggaaacaggcagagagccttgaatgccaagtcacaggaaggagggcagggccagggtcagagggacgcaggcccaggagccaggccggggcgggggcagggaggatcaagctgtcttgccctgccaggcagtgggtgtccagccttgcaagttcctgcctcgcaggtgtgggagggtttactttgtggtcataggttggggaggacacttctaggagtggcgagctaacctgttgggaaaactgcagaacatgcccgccctgagccagcctagaggtctggggagctcttgaccagtcccagtcccatgtgcaggcccagccattgatgtcccctgggatggaggggaggctgtgctgctgcccacagagcaggccgaggctgggtggtgcaggggcagcccctcagttgtctcccagcctggccctgggcgaggcctccctggttccctgcctctcggggctgtttcccacctccccgtcgactctggagctacctcgagccaggccccagcttgcagtgcaacaccaagctgcctgcacacccatccctcccacctaagccagccttcagccatgggctgggcagggcagagctgtgaggagagggctcgggctgggggctccttcccagctgagggtgctggctggtccttcctaggcgtcgggcctgttctctttttcaccaggaagtttcctgtgaagatctctgtctgctgcggccccactgttcccctggggcagatggtcagcaaccccaccccttgggaaaaggggtccctcctaaacaaatcagaccagaaggctcgaggccaggaagagcatgggcgagtcagcacgggtcatgatggacccttgggtgctggtagcttctaccaggtactgccagccaagccttgggccagctccaccacaggacaggaggagcccaggctgagtaaggtgggagtcagatgcggagagccctcgagagcctggcttcctggggaggaaggcacaggctgtggaactggtggcactcacctcacctggcagctctgtggcagcccagcagctgcttcttcctgtgacttccacagtcctgaagacgaaccctcaggggaggcccttgaagctggtctcctctccccaccccttcacctgcttcctaaggcagcagccctggagtgcaggtgtccgacacccccatgccaaccctgcacatgcagctccctcagcccagcttcccgggcttgccttgcacagggcctttccctgccagccccacgcgtgtgctcacgaggagtctttggggtctccctaagctccacacagccccatctccaccctgtttgctgcttccagctcggcactggtagggcctggctctgctctctcatgtccagtaactgttggctggagctcagcctggggtgcaggaaagggatctttttaggatcagctgtcttcattcctttggctgctctgttccctccacctggatccctttctcaaaatcgagctgtggaagccttgcctgcaggcgccacgccctctgggaggctccctgcggtctgagcccagggtggctcccagcttcaggctcagactgtggctggctgcctccagggtcctcacagatgtggcggtcgtcgctcagcacactcagggctgaggttgtgcttctcatttctgttgttttctgccgagatgtgcatgttctggttacccgggtgcatgttgaatgcataaacggggcctggactgagttcaagaaagcctgagctgtatccaggcaaccttgtgcaggttcccacccagaggctgctgtggcctctgcctggctcctgggcatctctgtgcctctgtctcccacatgttagaatggggatgacctcatggggtattaaagggccaccctagttgataaaggaaaaactacctgataagcacccacaactagtactgttacatcactgtcttccccgaagcaaggcccactgcatggtgctagcagggagattggggccccactgtgacgtgggcagaagctgagatgccagggtgggaggcacgaggggcctgcaggcatgactgggatgttgctgctgtaaacagtggtgtccccattaggggacatgtgcagacagcaagcaggctcagtgatgggaatggctccttggagaatctgcagggtgttgggggcaaggtgaggagggtcagaccctcacgatagctgtggcctgcacatggtggggtggggtcctcaccaaccgtctctgcccgctactacaccgggtaggggccaggggtgaccactgttctgcgcttctcctaggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggtaggcaagctgaggccaggaggcccagcgtgtgaggcccgggcgtgtgctctctgaagctcagttgcgccgtggagctggggcagctgcagtcccctcactggggtcccctcacagccctgctggagatgaacgaatgtgagacagtctgtttgccaccctgtgtgctatgggggtgcttctcccaggggtgccagtgctgtatttctcgctgacggatcacagtgacctgtccccaggaggcgctggcttgcagagcgcacaggccaggggccaccagcttccatggctggcctgagccagcatggtgcctgttggaggtggctttgctgcccaggtgaggggcttcctagcgaggaggagggctggacttctggcctcacccaagcctgtggtctgggaggggcacttggcggtttgaattctgtgcctgcctgagacgctcacctgtggtgtccacctcgctcagagcccttgtgctgcctgggatgaggctgtgtgtgtcgagtgctttcacagttcctagtgccaggaaggtgcttcggcagtttctcctcaaccacttaccctaacaacagcttgtgattgccaaagtaaccagcacatctagaagatggacccaaggggcctggatgggagctcaggtccagtgctctgcaccccaccctccagggtgttaactccccaacctgtgcagtgggcactgtgaggtcccctttcctgcttccctgactggcaggcggaaggctgggctgggctgctgtggctctggtgtggagagtggtggctggggagtgagtgcttggggagttgcccccacagagcctgttagcacttcagtgtcagaggccctgtgctgggccagggaccactgtctgctctttcctgagccttatggttccgaggctcagagcccagatggaagaggagggagcaggccccacagcaggcgagagctctccttccagagccccatcctcacccagtgactgccccaagatgcctggtgcacaggagggtatatggaggggtgtttgggctggtggcagaggaggaaggagatggctgtggagtcctcgagtctggggctcatgccttcaaggttctgtgtgtgtgaggaagaagcagtcggctacatggcctctggtctcttgggtgaggccctcagagggagcctcgcattgcctgcctggatcccggggtgctgcccccatctgctctgcctgctcctgagcctggggctggcccctgctgggtgagagcagcatgtacagaactgggcttgggggtgtcgcatggaaggctcagcccccagagctgtctgggcttgggagtgtcacacagaaggctcagcccccagagctgtctgtgatgtgctgggcacagcagcattgaggtggattctgtgcctttctgcagcacggccctggggtagaatttatggaaggccctgtgggggtctgtggctccacggccctggggtagaatttatggaaggccctgtgggggtctgtggttccgctagcaatgcccgttgggggctggggtgggaggtggctggtggagagtgtggcctctcagaggactgggcgctcccacatccagtgggcactcccagaagcagcccaggagtcatggtagctgtttacccctctctctccctgtggacccaagtccctgaggacaacggtgccttatttttttcaggaggtccctagagcctcacttggagtgggcacccaggaggggcagtgtgcctctgctgaagtaatgaattgttggggtgtaagcagtgctggggggtgcgggccagcgggcagctgggtagaggtggcagcacccggcctcatggggcgctgtccatggtgctgagtgtgtcggcccttgagggccaggagaggaggcaggaggagttgcaccaagccatgggcaggacccctggatctcccagcacacatagactgggtccagggctgctcctccttcccctccccttcttccccctccccctcctcttcccgcctccctcttctgtttctcttcatctctctccctctccctcctctcccctcttccccccccccctcctcccactttgcctgtctagccctttgtctcctctccacgctctctgtctctggccctcttggtgtcttggtgtctctctgcctctccctcttttcttctgcccctctttcccttggcttgggcacgtctctgctcgcctgtgtctgcagcagggcctgggcgttgctggggtggctcccaggttcctctgcctccacacgtcttccctccaggcagcctgggttgtgcagggaaccccgggttggaggtgatctgtgtcccacggggccacatgctggctccaagtcacgggagggagccgctttgctgctctcgtgtggggcacctggggacacgtgaacccctgtgtgcgtatctgtgtgtggagggggctgggtctgctgtgcggcgagtgctggtccatggggagcccagggaggaaccctcacctcacccctgtgagccaagggcctgtgggtagtgggcggtatttctcattagtttgttgtttttaattagagttgatttaattggtgctcagagggttggagggagaggcagacaccctggcctgttgcttggcaaagccttgagcaccctcagaggccagctggggccgctctgctcctgaggctggtgtggagctatggaggaggccctgggtccatgcctcctgctgcctggagaggctctgagcctccgtgttctcacctgggagggaaggcgggcgctctgtccccttgtctccgctttgcttctctcccaggactttggggcaccctttgttagcctgcgtgagtgcgtctgggctgtgggggggctgtagtcggctgtaatgctgccgagctcctgctgccctggggagcagctgtggggcctgggctggggtactgtgaggatcatcagagtgtgcttctgagaaaccctaggcctgtgagggctgctggcagcttcctgctcttgtgtgtgcccagggcctccaggccctcagttcccagccatgctcttgactgggtcagcccatgtgtggccacctggaactcctctgactcgcttgggccggggtgaggtcacagtggctgggtccctgccacaggactctgcctcctttccaggagggctcctggcgcctggccgtctcctgtggtcgtctgagtggatcatttgccaagagagattctgggcccaggagtgaggcttcccttccccggcttccaataacaccgtgctaccagggtggggtcggggctgagccggctccccacacagagtgggcctggggtgaggacaggggtccggttgtgtctgacatgggggcctccagcagttcactccagcaagagccccactgagtgctagggcgcagctcttaaggacctcaggccacggggaggaggtgggaggaggcgggaaggccaccacttccctgccttcgtctgccttcccgtccatgccccatccaccatcctgccctctgctcagctctctggccctgtgtctgtccagccaggtgggcagccctgctgccagccctccctccacctgttcatcattcattcattcagtgttcatggagcctctgccaggtgctgaggactcaggagtgaaggaagacagctgaacctctgcccggtggcccatgttctggggacaagacacctcccgggcctggtctctttgcagcctggtgtggtgcacagcggcataggcgtgccccagagagcagtcggcgggtggacggatgaccagagagcagtcggcgggtggacggatgagtggatggtgatgagttgcggcatgggcgtgccccagagagcagtcggcaggtggacggatgagtggatggtgatgagtggcgggctttttttccccacatatgaaatgagataaagcatgcagggtgcaggcctggaggtgccactttgcatagggtcatcagaggaaggactggagagcgtgaggggtgagccatctagcagcctgggaagaggtatggctggaggtggtgattcgagggacatgggtgtcccagtcatcttcagagcttgagaccacccaggatccccagggaatgggaagtgtggaggaagagctgccctgtgatggagaccagggcacctggacttacaagtggcagctggcggtgaggttggcggagcagcggaggtgtgcctggcgtagacggtgttctaggaaggaagagcatgcagaggcctctgcagaggccacgagaggacccaaggctgtgcactgcgccccgtgggtctgaggcaggagctggtccagccatgtggtgggggtgagggcttgctgggaatgggaggagaggggttgtggtgggcacctgtaggcaatgcttgtcttttagagagttttgcagcaaagtgaggcagagtgacaggggcaggggcaggagggagatggaggccaggagagttttatgaagttgggggtttgcagcccgtccatgccacgtgcatagtccaggagggaaggacaagtggacagtgtggacagaaaggggacagccctggagccgtgagggaagcagagtccaggacctccgggagtgcgggcctgtgcatctgcatagaccagcagatgcaggaagggtggcgtggaagtcctctaactgtgtccaagtttccactgaatttggaagcacgtccatcagccaaggtggggtgcgaagtgagacagagggagagggagcgagtgagtgagtgcgtggactagaagcccctccatccgctgccccagcctctcactccccctgccccaccctccatccaccccttctttgtccccttgtcatccattcactcattccttaggaaggggctcgtcgagcgcagctactacctcctcgtccctgttccagttgctggggacacagtagtgcacaacacaggccgttcctgccctctcagaggctgcgtcctcctgggcgaggcaggcagtgagtgttgcagggcagtcggggtgtagtgtgtccttccactggggtggggtggcccctggggagcagctccagcaggggagaggctgggagggtggcgggggcaggggggccttggctcgggcgttggagggctctgagcacaggtgtggcccaattgactcgtgatgggtgctgggggcacagtgtagacggtagggaaggagagtgggagccggaagcagtgatccaggtgggagtggtgagggtttgtaccagggagtggcgctggagaacggggcaggtgggctctgacacccagaaaaggtagagcccacgggaagccccgtggtgcctccggagtctgtcacccatcggcgcaggtgcctttccccttccgtgccccagccagtctcacgtgcatccacgctcccagtcctgtccccacgtcactgcctctgccctcccgggcccctcaggaagcccctgtcaagcctctggccctgtggggctggttgcacctgggggtcagggacatgggcagggcccccagaaccccaaagccctgcgcgtccccacccctgttgtggctccagcctggtgctaccctccatggcccttggggacatcagagaaacacatcctggctcaggcaggtggctctccgggggagctttccaaccacggcttcttgttttagtctaaattaaactgggatttctttccaggacatgtaattagagcccagctttctccctggacccggcctcctgtgggttgaagagagggtgtgtgggtgtgtggccgctgcaccaggagggagtctggtcagcggagctcaggggccgaggcactgctgaccctgagcttcctgggcaaccactgtggcctcctgttcttttgggctttgtggacgcaggccgattcagatggtggcaggcacttctcagggagaagccaggcccagctcagggccccacagagggtccccatgggcaaggagggtccacccaggggagcagcagcccatgtgcaagtgtgcggctcagggatgacctgacgctgtgtctgaaaacaggtgacagcccagagacgctgccttcccgcaaggcgacctgacgctgtgtctgaacacaggtgacagcccagagacgctgccttcccgcaaggcgacctgacgctgtgtctgaacacaggtgacagcccagagacgctgccttcccacaaggcgacctgacactgtgtctgaacacaggtgacaagagacactgtgcccgaggggccaggacacgttggagcatggaccgagctgggtgtgtccgtgctgtgacggaactcttctgccacaggctctgcttcagcctggggtccttggactgcagccctgcgggaggtgcagcaccccgacctccagtgccgggtcgggctggggtttgccagacattctctccctttccctaccagagtctggaaatggcctttgtaggccctgaccctccctccctcacccctagtgtggctggaaccggtggagcgggggctgagttctgacaagtccctggaaagcagggagagcccccgtgttctggggctggggctgggatcactccaggcattgcctgactgggggctccacagcccccctcgtgtcagtgagaacccaccaactccaccccacaatgcagggccctggcccacgtgcagtccatgtggtgtggctgtgaggaccaggtggggcggtggcgggtggctgctgatctaggaccctgtgaccaagctctggtgccccttcctgacagtggcctcccatcgggcctccatgtccgtggggacaggcctggcagccatgctggggatgtaacagcctgagaaggtgctgctctgatagggtgggatcctggccccctcttcagcacacgcccctggctgggtccttatggagggcctggcccatgcccccgctctctttctctgtgtctcccccctccctctctgcctccttcctgcatttcagggttcttaacactctcctggactggggggcagaactgggcccactgagagcccccagggtcccctgattctgtgcggggtgagggtccacactgcccgggcatgagacctggggcttggctgtgctgtgcttgggaggctgaccctggccttgggctccagtcctgtggggtcttctctggggtctccgcgtctccatgtgtgctctgctgcctgaggagcccaaatccagagactccctggatagaagcagcgcggggctggctcactggatgggcatcgggccagcgttgcagacgtctggggcctctcatatgcccgcctggcatagccgacccaagggagggttggcctctctgcggatctttcaccatggggactggagagctgaaggagcccagggctgcccttggataccgcagactttcccagggggacgggggacatgggtgggagataaggaagggaggtttcagctcaacccagagaaggactttcatcattcatgggggtctgggctgctgtcctcaggcaagtggggactggaccaggtggtctgtcctttactcatatgtccctgatatgggccaggtacttgctgggcacgatggagccagggcccttccccccagggtgcgtgttctgccaacggcaaagtccccatgccacaggatccactctgtgctccaggcctctcctctcgacggtgactgcaggccgggctccagggatgggcggttctgcaggtgtgcagagtcccccttacgcaggtgtgcacagagtcccccttacacgcctttctcttcaggggtcccaccaggagggtcagtcggaggcttgatttcctgccccagcagctggaggggtgggggtccagggagagtgtggtggggacagtgagcggcagagctggaggccgtgaggctggggtgagctgtgtgagaagccttgaaggtcacagtttggggagtctcagcccaggacccagctctgaggggacagttcgggagggatggggcaggtgggcagggcggcctgggggcctgggactggccatgctcgtctctctccgtggtgctgatctttccagctctgcctgtgggtgggggatggaagggagggacacagctgtgtggtgtcgggggcacacgcccactcctgggaccatggctggcctgtgcgtggccaggcaggttgggctctcagggcgcatggctactttaaattttgggtctgtggctgttgggctgatggagcacagccagggatctgagatgggctctaaacttgctgtcagtatttaagaaggaactttcacgcaaaaacctgtgttttcatcttgcttgggagaagtccctggagcccccactctctctggagcagctgcctctggatctgggaggctgggcgggcagtgccgggctggctgtagaagagccgcccctcctgggggctggcctgttcgaagccgtccgtggcctccggtccaggctcgggctccaggtgctcactggggctgctgtgttccagtgccctggggggtcccaggcctgtggcggctcgcgaggatggctaggctggtgtggtgcggtggctgggggacaggggacctgcattctgtgcagatgcacccacagaggtcacaggggttcaagttcataccccgggagggtgggagccttgctcctgtgggcacgtggtggtggacaccccttcctgctctccttctcctccttcacactggagcggcagagttgcagattcacactgaggtgaggatggttgctaatggcttctcgggccctggactagaagaggtgagaaggcaggtgctggctgtggggctgtagagtggaggggcctccaccctgcgtgcctgtgtgcagccccacacgtgctgaagcatctctactccagccagacggacgctaacgcagattcattcctagcaggtcacatggtagcaccccccacccagtccctgccctcttcacgaccctgctgtgagctcctttctccagggctgggcaggcccttctagccaatgccaccctccctgtctcccctgagagcacaggagcctggtgaaaagggccttgcgccttggtcctcctcactcagtgtgcggcctctgtgtcttctccactcccaccccttcttccccaccaggctggcctctctttgccctcctccctccccgagaagtttccctgctggctcaccacaaagcccagcctctactgacaggctcattcccttgaacgactggacactggtctgctggggaggctggagcaaagcagcacagccgggcgctgcaacagcagacatttccttctcagtcctggaggctggaggtccaagatcagggtgttggcaggattggtttctggcgaggcctctcctcctggctggcagatgactgccttcttgtggtgggcggtgctgatccgatggaccccagaccctggggcaggcgggatgcagggccaggcctgcggggtccactgtggccatgtggctgttgctggtgcatcattgcatcgtgaaatggttagatggtttgatgtctgcagaatccgccatagttctccccctttcctctgactgtgggtcctttctcacgcttctctgtcatcagcctctgggcctgacaacacagctgcactggagccacaggcaccccgaaggggccaagggtgggaccaggtgaggaggaggggcactgtgagactgcaggcaggagggacgtcccccagcacagggcagcctcccgtccaagggtgggggctcctgagcaccacctcctgctctgcctgccggtcccaccccagcacctgctgtcttaaagccttgctctgggagtacagcgtgtggggagggaatggtgtccctgttcccatcacgggcctactcagcactgggtggaattcgacactgcaggcagacaggcagagactagagaccaggagcagcaggtggggtggccgccgtgtttccattggcatgcatcagaggtgcgtgggctcccagagcccgacaggcctgaaacgcccagacacacagatacagggacacacgggaggggggccgccatggcactccgtgtctcgcctggtgctgggctctgtgccatctccagtgaggggctctctccaggagggcaaaggccccccaccctcccaggaggtgcctttactccacggacttgccaggatccacagcctgggaccgtgggcatgtgggtgaaggcccggtgcacagctgctagaagtgagcagcacagctcctgagacatgaaaaggtaaaagaaaaaataaaagctggcccttttttttttttttttttaaagctgactcttttgtgaggtttattatgtgctggctgctgttttaataacaataattttataaatccaagaactagacgctgatattaacaactcccccctttaaaaaaaaaaaaaacactgggtgcggtggctcatgcctgtaatcccagcactttgggaggctgaggtgggcagatcacgaggtcaggagttcgagaccagcctgaccaacatggtgaaaccccatctctactaaaaatacaaaagaatgagccgggcaaggtggcacgcgcctgtaatcccacttactcagggggctgaggcaggaggatcgcttgaacccaggaggcgaagcttgcagtgagctgagatcgcgccattgcactccagcctgggcgacagagtgagactctgtctcaaaaaaaaaaaaatgaaacaaaataaaataaaataaaataaaggttttattttgagctaattatagattcataataggcagttgtaataaatggtatagagagagcagtgtactctttacccagttcccccaaaggaaacctcttaggaaactgtaatagcagggccacggtctcatgactaggtgctgagattgacacagggcccagaacagcccgtcccgggagggcccctcatgctgcccttctatggctgcacccaccttcctcctacttacctcacccaccttccctttactcgctggcaaccactcatctgtgcatttgtataattttgtcatttcgatgatcttagataaatgaagtcatacctttggatttgcctttttcacccatttgcttcatgaaatactatgaacaaagctgtatacacattcatgtacaggtttttgtgtaaatataagttctcacttctctgggataaatgaccaagagtacaaagagtacaatcattaggccatgctgtagtcacatttttagttttttaagaaactgccaaactctcagccagagtggatgtcccgtttcacatttccagcagcacaggagccgtcccttctccacagcctcgccggcacgggggttgtctctgtattttttttttttttttttttttgattctgatagatatgtcgtgatcgttgtggctttgatctgcatttccatgatattggacgtcttttcatgtggttctctgccatctgcatatccttttattttttttcagatggagtctcgctctgtcatccaggctggagtgcagtggctctatctcaggtcactgcaagcccctgggttcacgccattctcctgcctcagcctcccgagtagctgggactgcaggcgcccgccaccacgcccggctcattttttgtatttttagtagagacggggtttcaccgtgtgagccaggatgatctcgatctcctgacctcgtgatccgcccacctcggcctcccaaagtgctgggattacaggcatgagccaccgtgcctggccctacatatccttttagttgaaatgtgtcttcatatattttgctcatattccagttggattgtttgatattagtctattgcttgatatgtggtttttcagatattttttcctactctgtagcttttttctcccattttcgtaacagagactttgcgcagcaaaacttttaaattttgatgaagtccaatttgtccgtttttccttttgtggataaggcttgtggtgcgaactctttgccagccctagagcgtgaagatttttcccgtgattctctttttctaaaagttttgttattttacattttacacatatcagctgtgaggtttaggttgaggagtttgttttgttttttgcctgtgggtgtccagtggcaccagcaccatttgttgaaagggctgcatttcttccattgaattgcttttgtgctttatcaaaaaccaactgggcgtgcttgtctggacctatttctgggttctttattccgttccattgatctgtgtgtgtccctcgtaccacacagtcctgatcacggtagttatgtaataaggcttgaaactgggtagtacttactcctcccaatttattctttttctttcaaattattttagctattctaggtactttgcctttcatatacattttagaataatcttgtcaatatatacaaaaaatcttgatatataaaaaaaatcagtttcaagccagaattatataaaacctgtatgttagtttatgaacatttttactatgttaagtcttccaatctaggaacatggtatatttctccatttatgtagatctttgattgctttcatcggcattttgcagttttagggatacaagtcctgtacatgttttgttacatttacatctaagtatttcttttattttgtgtgattatagatggtattgcattttaaattttggtatctgtatgtccattgctagtatatagaaaaaccatagatttctatatgtttatcatgctaaactaacttagtagtagttctaggacaatttctttggagattctctggaatttcctatgttgacaaacacgtcatctgcaaagaggaacagctttgtttcttctcttaaaacctgaatgccttttcttttcttaccttattgcatttactagaacttctagtactgtgttgaagagtggtgtggcgagagaggcattgttactttgttccaaatttcaggaggaaaacattctgactttaaccattaagaataatgttagtggctgggcgtagtggctcacgcctgtaatcccagcactttgggaggccaagacaggcagatcacgaggtcaggagatcgagaccatcctggctaacacggtgaaaccctgtctctactaaaaatacaaaaagttagccgggtgtggtggcaggcgcctgtagtcccacctactcgggaggctgaggcaggagaatggcgtgaacctgggtggcggagcttgcagtgagccgagattgcaccactgcagtccagcctgggggacagagcgagactctgtctcaaaaaaaaaaaaaaaaaaaaaagttagctgtagggttttgtagttgctctttattaagttgaggcagtttccctctgttccagttttccaggcactattatagtaaatgactgttagattttatcaaatgctttttttgcattggtatgatcatgtgatgtttcttctttaggatgttaatacagtggattacagtggttgattttttgagtcttgaactagggatacatccctggaatagacatggttgtggtatataattcttttgatattgctgaagtctatttgccaatatcttgttaaggatttttacatatgtattcatgaaggctattggtctgtagtgttttttggtaccgtctttgtcttgttttgatgtcagtgtgatacaagcttcataaaatgaatttagaaatgctctccctcttctattttctaaaagccgttgtgtgaaaacggaattagttctttaatgtttgttagaaaaatctacagtgaatccaactggccctggagatttcctttttgggagctttcaagttacgcattcactttccttacgagttatgtggatgttcaaatgatctgtgtcatgttgggtccgtcgtgtgagtttgcattttctgaggaagtggtccatttagtccaactcgttgaatttatgtgtgtagagttgttcacagtgttccctcattgtccttttgatgtctgtagggtttgtaatagctcgtttcatttcttatattagtaatttttgtcttctctttttgttcctgtgtgtgtggggctttttctttccggtcagtcttgctggaaatttgtcaattatgtcagttttttttcccagagagccagctctctgtttgtatggttgattttctcttttttgcttactatttcatttatttctgcccttattttattacttccttcattctgtttgatttgagtttattttactcttcattttctctgttcttgtggcaagagcttagactagtgattgcagtttttgtttttttctaacatatacatataatactataaatttgcttcttaggttgggtgcggtggctcatggttgtaatcccagcactttgggaggccaaggcaggtggatcacctgaggtcaggagttcaagaccagcctggctaacatggtgaaaccccatctctactaaaaatacaaaaattagccaggcgtggtgacgggcgcctgtactcccagctactcaggaggctgaggcaggagaatcacttgaacccggaaggtagaggttgcgatgagccgagatcgtgccactgcacttcaacctgggcaacagagcaagactccgtctcaaaaaataaaaggaaaaacaaaaagtttgcttcttagcactactttaactgtatactacacattttaatatgttgtattttcgatttaattcaattccgtgtattttattttgtgtttttatcattttaatcattattattattattattatatttttgcagcgatctcagctcactgcaacctctgcctcctgggttcacaccattctcctgcctcagcctcccgagtagctgggactataggcacccaccaccatggccagctaatttttgtatttttagtagagatggggtttcaaatgaaattttatttacccacatttttactctttccatttttctatcttcctaatggccaacaattaaaataaaaataatattctttctgtttagataaatttctttaattattctttcaggataggtctgctggtgacaaattctcttaatatttattcacctgagaatgacctgatttcccctccattccccaaagatattttgctggatatagacatctgggttgacaattcttttctttcagcatgtgaaaatactgtgcaactgccttctgaccttcatggtttatgatgagaaatcttctgtcagctgagttgtttttccaaatagaaaaggtattatgtttctctgatgctttcaataatttttgtttttagtttttggaaatttgactgtgatgcatcttgttttgattatctttgagttgatcctgtttggggtcccctcagcttcttgaatctgtaggtttatttctcttaccaaatttggcaagttctcagccattatatctttgagtactttttcagtcctgccttcattctcctttttttctggaactctgatgatactaatattatggttccatagttccttgaggctctgttgttcttcttcttcttgttttttctttctttttattttttgagacagggtcttaatctgttgctcaggctggagtgcagtagcatgatcatggcttgctgcagcctccaccttccaggctaaagcaatcctcccacctcagcctcccgagtagctgggactacaggcacatgccaccaagcctgaatacttaaaaaaaatttttttttttttttttgagatggagtctccctctgtcacccaggctggagtgcagtggcacgatctcagctcactacaagctccacctcctgggttcacgccattctcctgcctcagtctcccaagtagctgggactataggcacccgtccccatgcccacttaattttttgtatttttagtagagacggggtttcaccatgttagccaggatgtctcgatctcctgacctcatgatccgcctgcctcagcctccctaaaaatttttttgttgagatggagtctaactatgttgcccaggctggtttaaaactcctggactcaagcagtcctcccgcctcagctttccaaagtgctgggattgtaggtgtgagccaccctgcctggccttcttttttctctctttctttcttttttttttgtcagttggagtctctctctgttgcccagggtggagtgcagtgctgcaatctcagctcactgcaacctccgcctcctaggttcaagcaattgtcctgccttagcttcttgggtagcgggattacaggcgcgctccaccatgccaggctaatttttgtatttttttttttagtagaggtggggtttcaccatgttggccaggctggtctcgaactcctgatctcagatgatccacctgtcttggcctcccaaagcgctgggattgggatatgctttcttaacctcagtttccttctcttacaaagaactgtgtagtctgccaactcctgagggtgtcatgagagtccctggcttgtagtaatggctcaccgctgtcgtgtgtgtgcttggggttggggttccccgcatgccatgcctagctcttcttctcccctgtccttgctttggagcaggctaggtggctcccacttcttggcctgttagagcagggactggggtggggaggccgaggggatgctgtggcgtctttggccgagaactgccggctctctccatggcaactgcaagcaggcttctgggtgagaaccagtgcctggaaggtcagtgacaaagcagatcctggagatggtgcctcccctgccagcttggctcccatgtagaaccagcctgagagtagtaagcagtctccctggactgggcctgactggcacctgacccacctgccccggcccagggacccccgcacctgtgcaggatttgtggtctcccctggctcagcgcagaccctctgaggggctggtccaggttgatggggcgtgggtagggctctgtgccacagggacggggtacaggggctggccagcgtgggccagatgcatggggacaagggagcatccatagtttctcatagaacataacagctctgagtccccagtcacctctgccagctcttggcattttcagaactggggggtcctgtggggtatggctgggctgtgaagtgtggaggtggctagaccaggcctgactggggtgtgccccagaagctcctcacagacggctgtggaaaggcagggtgcccccctggcccacgcggagggtgtgtgaggtgcccccctggtccaggtggagggcgtgtggctgggacctagagtctgggggatgtgaggtgagttttgggttagggttagggggcccagaagaagcctgcagcagtgtggttccagccttcctcccctctgtggggctgggagcactccccgaccttgggtgccagagtgagggcgggtctttacatgtgtgactgctgttgtgtctctgctgtgtgtgtctgcgccgtgtgtctctgtgtctgtgtatgtgtgtctctgtgtccgtgtctgtactgtgtgtctctgtgtctgtgtctgtgtgtctctgtgtccgtgtgtccatgtctgtgctgtgtgtctctgtgtctgtctatgtgtgtctctgtgtccgtgtgtccatgtctgtgccgtgtgtctctgtgtctgtgtatgtgtgtctctgtgtctgtgtgtctgtgctgtgtgtccctgtgtttgtgtatgtgtgtctctgtgttcgtgtctgtgctgtgtgtccctgtgtctgtgccgtgtgtctctgtgtctgtgctgtgtgtctctctgtccctgtgtctgtgtgtccctgtgtccttgtgtctgtgtgtgtaccgtgtgtccctgtgtctgtgtgtccttgtgtctgtgctgtgtgtccctgtgtctgtgtctgtgtgtccttgtgtccgtgtgtctgtgtgtgtaccgtgtgtccgtgtgtctgtgtctgtgccatggtgtgtctctgtctgtgccttgtgtctgtgtgtctgtgctgtgtgtctctgtgtctgtgtccctgtgtccgtgtctgtgctgtgtgtctctgtgtccgtgtgtccgtgtctgtgctgtgtgtccgtgtgtctgtgctgtgtgtctctctgtccctgtgtctgtgtctgtgtgtccttgtgtctgtgtgtctgtgtctgtgctgtgtgtctctgtgtccctgtgactgtgtttgtgtctgtgtgtctctgtgtccctgtgtcagtgtctgtactgtgtgtctctgtgtctgtgtccctgtgtctgtgtctgttctgtgtgtctctgtgttcctgtgtctgtgtctctgtgtctgtgtgtccgtgtctgtgccatgtgtcccatccctatgtctgtgccgtgtgtctctgtgttcctgtgtccgtgtgtctgtgtctatgcctgcgtgtctgtgtgtccctgtgtccatgtctgcaacctccaccgccctcccgggttcaagtgattttcctgcctcagcctcctaagtagctgggattacaggcgcataccaccaagcccagctgatttttgtatttttagtagcgatggggttattattattttgcattattttggtgatacagattgtcagagtggactgggtacaagtgtttaaacatttcatggctcctgagacattttgccaatttgttttccaaatgggatatataagtttgtattccaccagttctgtgtacatcattagggtttttttgtgatttttttttttttttttttttgagactgagtctagatctgttgcccaggctagagtgcagtggtgcgatctcagctcactgcaacctcaacctccagggttcacatgattctcctgcctcagcctcttgagtagctgggactacaggcacccacgactacacctgggtgattttttgtatttttaatagagacggggtttcaccatgttggtcaggctggcgtggaactcttgacctcaagtgatccacccgcctcgacctcccaaagtgctgggattacaggcgtgagccactgcatctggcctaaatcattagttttaatgtcagctttgccaccactggatatattttcttgttatatccagtgttttatatccagctcttgttaatttattcaatataaatctgtaccttgttgtccttttccattactgatgagtttgagcatgttcacacattactaaatggtgtttacttttgtgagttgtctctggggttctttgccatttcattttggaaatttctccattaacgtttattgagtgcacactgcctaccaggtactgtgcctggcctggagctaagaaggaaaacactgcttcctcctggagaaggagaaactaggggtggagtgagaggtcccactggctcctagcccctccccaacacccctcctctccaaggcagctgttgcctccttgcttttcagtaggatttttctagagcctaaggcttcagggcgtagaaagtacccaatacttgtgttggtatttaatacttgttaagttcgcatgtgtgtgttgtaatttccttttttctattgttgttaatataacatctttaatttaaatacctcaaagttgttttatttagtatttgtttacatgtcagcagaggataaacatttttcttttctgtttacaaaaagtaactgattttcttactttatgacacacactgccaccatcctgtgatatccactgttaatattttgagctatttccttccttccaagctttttcggtgtgtaggtttttaaatacacaattgatatcaccctccagggctactgcgggcacccccctcctgtcgtgggcaggccacctggtgcagctgtgccggctggtacaagatgcagggtgagggccccacgagtgctcactgcacacagatgtctcagcatctgatgtcccggcaacccccactgccgagtgtcctctgaggagacgattctgccttgtgggcagaactctgtcagattcctcttgtcaagcatttgggttatttcctattttgcttttgtagataaaccaaaacgcatacctatatctttagacatctctgattatttccttgggacaaatgcctaaaagttggatgagctttgtttttcctgtaaattatactattaaaaaactcttcaccggtggctcacgcctgtaattccagcactttgggaggctgaggcgggcggatcacggggtcaagagatcgagaccattatggtcaacacggtgaaaccccgtctctactaaaaatacaaaaaaaaattagccaggcatggtggtgcgcgcctgtagtcccagctactcgggagcctgaggcaggagaatcacttgaacccaggaggtggaggttgcagtgagccgagattgagccactgcactccagcctggcgagagagcgagactccatctcaaacaaacaaaaacccttcaccttctcatcacttggtcgtgctctgcttcgactcatacgcatcagtggtctctctctgtccgtgcctgtggtctcgttgtgtagctcagaggaggggtttaatgtctcatgaagccagtcccgttctccttgcttttcttctttgaatcattttttaacgttttgcctacttagttttccagatagattttgagatcattttgttgtagtcccaataaccccgctgggattttgatttatcagaatctataaattgatttcaggggaatcaagtttagaaataaatatatattctgtctgtccatccaggaatgtagtatgtatgaaaatttattcagctctccttttttttttgtaaatagattttgtagtttctttataaaagtcacctgcactgttaaagctattcctaagtggtttgtattgattggcggcatttcgattgaggcatttattttgttgcatttcctggctgtccctgtctggtgtcactgctggcttctggtgtttgtccatccatcaggctgctggttctgggtgccagtgcacaccccttctgggtagagctgggcagcgctttgtttgctgatgggcttggaccgaagttttggttgtgattacggtacctggaggttgcttttcctgccagttttttcctttctctcattggtttgatctcatcatcctgtgcttttgggttttgtgctgctttctgtcttttttggaagtcgggaggggcacacaaaccagaaggaagcttttcaagctgatgctctggaccactggggctcacaacttgggtgaacatcagaatcatcctgtaaggcatgtaaaacccagagtgctgggccctgccctctgatttctgagttctttctgggaaagaattagcatttctttctttcaaaatatgtatatatattttactatttctctctctctctctcttttttttttttttttttttttgagaggcagggtcttgctctatcactctgttgcccaggctggagtgcagtggtgtgatcatggctcactgcagcctcaacctcctgggctcaagccatcctcccaccttagcctcctgagggtggaactacaggtgtgtgccaccatgcctggctaattaaaaaaattttttttttgtagagatgggtctcatatgttgtccaggctaatctttaactcctgggctcaggcgatcctcccacctctgcctctcaaagggctacgattacaggtgtgagccactgcactgcctccgcctcccccctcctcctgctgtcccctcaagaatttgctaatggtctgccaggtgatgctgaggctgctgggagatcctgggttggttcttaaccaagttcctgggagttttatcactgtctgccatcggtgatcattttatctatttttttccttatttcctattcatgtcctactatgttggtgagaactcttaaaacaacattaaatgagaattatggtgatacttcttattttgttatctgacttgaagaaaatccttcatgataaatgtgggtttgttagtactcttgagaatggattttgtgcgtagaaaatatttttcagaaactagtttctaaatgtcaacattcaatttttaaagttagaaatccaaaaacgttgggtttttaaaagcttttaggggccaggcgtggtggcttatacctgtaatcccagcactttgggaggccgaggcgggtggatcacgaggtcaggagtttgaaaccagcctaaccagcatggtgaaaccccgtctctactaaaaatacaaaaattagccaggtgtggtggcacgtgcctgtagtcccagctacttgggaggctgaagcaggagaatcgcttgaacccaggaggcggagcttgcagtgagccgagattgtgccactgcactccagcctgggtgacagagtgagactctgtctcaaaaaaaaaaaaaaaacttttagattcaacttatgaaaaattatatttgtaaatttagcaatttttaacattcattttcaagaagattttaagtaatgttttatcctattttataaacttaagttagacatttaaaattttgtttataaatttactgtaactagaccttcctaagtacttaagtattgtatgttgaataaattaaagtgtaaatatggtgagtcataaatttgcttcaatggttcaatactttctataaatttattaggttttcaacttaaaattacaagtctcaatcagttccattgtatattttaaattcaaatcacagggccaatgtaatgctaaatacagcttcatatggtctgataaattcttcatcataactcaaaaaatattaattcggaaaatctgatttccacaaacattgctacatttaattctcagccttcctggggttaaatatgctggttcgctgaagacactgtcacctcccgacaagtgaatggaggtgtcctgcccttgtcctaagacactgtcacctcggacctgcccttgtgccctctgggctgcctcatcacatttgctggctggaatggctggaatgtagaccagattttttcctgaaaaatactagtggactatggcaagggcctctccactcaaatgctggaggcctcagaggcccagtgggctgcagttaggttgtaatttattccagaggctgcttacaccactggagcggattttgtgtttttatggctctcaagattatagaaatgtccagcctgggtctacacaactttgaattcttcgtcaaaaaagaagagatgttttccggccccagaggattatagcaactcctccttgttaaaatgcgtttctgtctttcatgtctttggcttgccagggtgactcctaaggccgctttgctgacatttcaggatttgtcagagagcgtcctggtgcctgggagacagaaaagctataaggtgaagggagggagaaacttttcctcctatgtaatttgtcttacttgggaatggaattggagctttgcaggagctgttcactgtctgggtcatctgtgtttccagtctcggtcttgctgactccatgcccgtgtgttgtgttattgaacatacgtgttcccctgcatgtccatgtgttgtcttatttaacatacgtctttctctgcatccccgtgtgatgccttatttaacatatgtgtgtctctgcatccctgtgtgatgtcttaacatacatgttcccctgtatgcccatgtgatgtcttatttaacatacgtgttcccctgcatgcccatgtgatgtcttatttaacatatgtgtttctcttcatccccatgtgatgcattatttaacatacatgtttctctgcatccctgtgtgatgtcttttttaacatatgtattcctctgcatgccatgtgatgtattatttaacatatgtgttcccctgcatgcctgtgtctagtcttatttaacatacgtgttcctctgcactctcccctggtctgcatttctctgtacattgggagttagcttgggagatttttcttagagaactaaaatattacagatgtggttgaagtcttctgaatacagtcccccagtcagattctcttctctttctctttttctccctgtgggagcaggtgtcctgatttgtgtttatcctgccagggcacgtgggtgtgtgggcattccacctttcgctgtgtgtgtatccataaatgatgtagcgtgtgagtgtgtctgtgtattcacacacagatatatgattatttcacagctctcctctaccccttaacattattttaaacatttttccatgttaacgtgcataggcttatttagttttacatgctcattcatttttaactgtggaataatattccattgtgtgcatttgccacagttaatttttctgtcttcttgtgaaaggcatttttattttcctttcttactattacaaacagggctaccccagaatgtgcctggggtgtggttagaagtggtttcctgaatcctggggatgctcatttaaaactttcctagaagtggccaaatactctccaaaacgattctacagttctctcttccaacacatcaccaggctttaacactgtgtgctaaatgtaggatgtcaagtggcagctcttcgttattttaatctggatttccctgattgccaatcgttttgagcatcttcttccctcttgtaatttgttgatttttctgattagttatttgtatttttcatatgaatttgtagaaattttttctacattcagaaaaccaattctttttcattttctttatgctgtcttttatggtgtggtgttattttatcgtagtcacatttattaatctattactttagtcttaagtcatccttccttacctcaccatcactgagctgttctcttgtatttttttgcagctttagagtttgctttccatgcttaggtctttgatacacctggaatttatgtgtgagtgatgcttcctctttctgccgacgggtgacctggttttccaacatcatttggcggctgctccaccctttttccatgatttggaacggcgccaccgcctttgtcaaacacccggtttcatacgtcaggcctgtttctggctctcgttctgccccatgccttccctgtccaatccacagagtattaattattttagcttaacagtaagtcttggggagtgaagcaagagctaatttcctggtttgttcttcagcatcgcttgactgttcatggcccattgcttgtccatgtggatgtaaagatgagcttgttaagttctaccagggttctgctgaggtcttttattaaaaacaactttactgaggctgggcgcggtggctcacgcctgtaatcccagtactttgggaggctgaggcgggcggatcacctgaggtcaggagttcgagaccagcctggccaacatggtggaaccccgtctctaataaaaatacaaaaattagccaggtatggtggcgagtgcctgtaatcccagctactcgggaggctgaggcaggagaatcgcttgaacccaggaggcggaggttacagtgagccaagatcacgccattgcattccagcctgggcgacagagtgagactccgtctcaaaagaaaaacaaacaaacaaacaaaaaaaacctttaagatataacttaacacaccatataattttcccatttaaagtgtacaagtcagtggttttggcatattaaatttttaattattattattatttttttgagagggagtcttgctctgtcgcccaggcttgactgcagtggtgcgatcttggctcactgcaagctccgcctcctgggttcacgccattctcctgcctcagccttccgagtagctgggactacaggcacctgccaccatgcctggctaatttttttgtatttttagtacagtcggggtttcaccatgttagccaggatggtctcgatctcctgacctcgtgatccgtccgcctcggcctcccaaagtgctgggattatgggcgtgagccaccacacctggctaaatttttaatttttaaaaattgtggtaaaatatgtataacatgaagttttctgttttaacctttttttttttttttgagacagaatttcgctcttgttgcccaggctggagtgcaatggtgcaatctcggctcactgcaacctccgcctcctgggttccagcgattctcccacctcagcctcccgagtagctgggattacacgcatgcaccaccacgcctggctaattttgtatttttagtagagacggggtttctccatgttggtcaggcttgtctcaaactcctgaccttaggtgatccacctgcctcagcctctcaaagtgctgggatgacaggcgtgagccactgcgcccggctttgcaatttccaatttttttattgccccaaacagaaacttagtgcctattaagcaagaactccccacttcccttccttcagccttggcttagcgctaatttacttactgtctctatgaatttgcctcttccaggtacctcatgtaagtgggagcgtatgttatttgcccttttgtgtctggattatttcacttagaataatgttacccaagttcatccatgctggagcaaatgcagcattagagcgtcgttccttttgtggaggaagaacagttattcatgtgcatgccccacattgtgcgcacacattcatcaggtgatagacatttgtgttcctcccctcttccggttattgtgagtgacgctgctatgagcgttgctgtctaagtatctgattgagtcctgctttcaattcttttggatatatagctagaaggggaattgctggatcttatgttaattctatgtttaacttttttttttcatttttagttttttttgagatggagtctcactctatcacccaggctggagtgcagtggcatgatctcagctcactgcaacctccacctctcgggttcaagtgattcttgtgcctcagcctcccaagtggttgggattacaggcccccatcaccatgcctggctaatttttgtatttttagtagagacagcatttcaccatgttggccaggctggttttgaacttctgacctcaggtgatctgcctgcttcggcctcccaaagtgttgggattacaggtgtgagccaccgcgcctggccaataatagctatcttagtgagtatgaagtggtatttcattgtggttttgatgtttacttccctaatgattagtgatgttgagcatcttttcgtgcacctatcggccatttgtgtatcttctttggaagaatgttcattcaagtccgttgcccattttaaaattgagttgtttttattgttgttgagttgtaagagtatttatattttctggatattaatcccttattagagatatgatttgcagatattttctccctttctgtaggtttcttttcactttttgatagtgccctctggtgcagcagcccccaacctttatgacaccaggcactgggctcatggaagacaatttttccacagaccagaggtcgggggatggttttgggacgattcaagtgcgttattacatttattgtgcactttgtttctattattgttacattgtgatatataatgaaataattatacaactcaccataatatagagtcagtgggagccctgagattgttgtcctgcaactagacggtcccatctgggggtgatgggtcagtgacagatcatcaggcataagattctcataaggagcgtgcaacctagatccctcacatgtgcagttcacagtaggattcatgctcctatgagaatctaataccaccgccgatctgacaggaggcggagctcaggcagtaatgctcgttcgcctgccgccacctcctgcagagtggcctgattcctaacaggccacagaacagtactggtctgtggcctgagggttggggacccttgctctgatgcacggaactttttacttttgatgaagttcaatctaatctattttttcttttattgcctgtgctcttggtgtcatatccgagaaattattgccaaatccaatgttatgaatattttcccctatgtttcttctaagagttttctagtcttagctcttatatttagatctttgatccattttgagttactttctgtatttggtgtaaggtaagggtccaactttattctgcttggttgttgaaaagatcattctttctccacttaatggtcttggtacctttgttgaaaaccagttgacatatatgtgggggtttatttctgggttattattctattccgttgatctagctagttttaaattttctaccttttctacctgtttttgtttaatagtttactgtttttatctgaacaaaattcctctttcaatagttgatcctgctgaatgtcttcccgtagcattgggcttcctcaggtaacctggcattttggtttgaatagaagggtttttattgtcctttttttctttttttattttgagatatttatcttttctttatttatttattcgagtcggagtctcgctctgtagcccagactggagtgcaatggcgcaatctcggctcactgcaacctctgcctcctgggctcaagcagttctcctgcctcagcctcccgagtagctggaattacaggcatgcgctactgcgcccagctagtttttgtatttttttttgtagagacggggtttcaccatgttggtcaggctggtctcgaactcctgacctcaggggatccacctgccttggcctcccaaagtactgggattacaggcgtgaaccactgtgcccggccgatatttatcctatttttgacccccagttctgtctcagattttgtctgttacggctatgtgtttggagcgggtgatcacaaagccttcgccaagaaccctggatgcgcgttagaggcagagccagcaggattgttggtgacccggacgtggcatatgagagaaggaccggagtcagggatgaagtttcaggtttggtttaaacaataggtgactggtgcgatccgctgaggggaacaaagggggaaggagcaggactggaagtaagaatagaaagtttcttagtcactgtgatgtaacaactctgaactttagaaaaaaggtacatcttttatacttgtgttaaagtgaaaaaaataattctttagttgtgtaatgtttcatatgctttttaaaatacccatatggaactgttaaaaaggcagttgtatatatgagcctagagctccaggtctggattaaagatacacacttgggaataacggacatgcgtgatactcaaagctattgggtagctcctacatggaatgagccttggggcaccctcgttttgaatctctggcagagaaggcaaagctggcaaaagaaactaagaaggagcccccagggagtgggaggaaaacaggagagagttggcctaaggcaagagaccacaccctttaaaggagacttgaccgttagaattggcaagaggaaggcttgaggtagcatttcagtggagaggtgggtgagaacctggctggagaaagctaatgagagagctcaagataaggaagtggtgagaccgaggattgacaccatccgtgagttctgatgggaagggaacagagaaatgctctgtggtagaaggcagatatgggatctttagttttgttcttaagatgggagatactgggatatgtttttttgctaatagaactgaccacagtgtcttcctcattccacctttccaataccccacttccctgtcttcctgagataagggaaagaatggtggtatatgggggtcggttcaggagtccctcaggctccatcctgctcctgctctcagtctccactcctctcagaaggcagcttgaagtgcagctggggttggttaggggatatgggtcagccttaaactcaattggtagacagatttcctgccatgccaggggccaagtgtctattcagagatggtgcctttgaactggaggtttggtcatgtgggtgattgtgaacattcctgtgagcgcttctggattcagttcctgcctcctctcacctggcaagccgctctgtgctggccctgtggttggacagtggggggacacaggtgctggccctgtggttggacagtggggacacaggaatgaaggtgtcactgctcttgggagacatgaccctggtggtgggaggagtgtgtcctcttccaggctcaatgtggaaacctttacttcccttcttctccttgtttctgccaggatccttgccacggctggaactgacttcgacctgcgaacactgagggctgtgcgtgtgctgaggcccctgaagctggtgtctgggattccaagtgagtccagcgaagacaggcccaagccggcttggagtaacaacctcctctcctaccctcaccacggacatggccatggccatggtttggctttggtgactctgagcttgccacttttgaccccagggaaccaggcaggaggaagggaggagcaggccttttttggcctgtcacaccctccatgaaagcccacagggtgatgctgttattttaccctgacctggcttccctagatggaagctttgttcctcctcacatactctgtcacatttcagcattttgcttctttttctgagggtaaagaatggatgagaggttgaccaaggtggtggggaaggatgcctgagaaaatgtgcaaaagctgcaaagggccacttgtctcttggctcagtcttgtcagggccactggggactgaggccagccttaagacatgctcctgaagtgggctgcccacagagcctgccatgagcaggaggatggccagggtgacctcatgagccagtgaccacctggacccctattccttcagcccagtggaagtctggttttaggtttacctaagggcctgagtggacatggaactagagctgtgtcctcctgaggccactgagggaagacccgtgattggctccctgttctaccctgagaccttgccaggcaatggttctggcccatatccaagtgctggggccagactcgaaggggaggggtcaaggtttacaggctcctctgcccagttcctcacatgctgtatggccagtggcagaacattcccaggggcaggtcttttttgcctcactttctcccaaggagttgggtctgttaggaatacctgtacttctcccccaggatcccctgctcttccctcccagggtcccctcctcttagctcccagcattctctgctccttcctcccaggatcccctgcccttagctcccagcattctctgctcttccctcctagaattccctgttctttcctctcaggatgtcctctgacttggctcttccttctcaggatttcattctctttcctctcaggattctctgttgccccaccctgagccccactccccaccccagacttcataccctgacacccccacatcccactcctctgcctactttgagacacttctcagtcgacttctctctaggaccttatgctttgtccctaggactctcagctctgccctacacaagcactctctgcccctctgcgccttaaggggcttcagctctatcctttgcccttgcaagcactcactgcttagcaccttgctgtccctgctaggttcctgctgttctgtccctgcccccaccaaattccttgccctaccctgcccacgttgcttcctgacctgccctgttctggccccaggtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacaggtgaggccaggcagcaccctccagcacaggcaagtgccacggatgcgttcatccaggagatgggcactgttctaggtgctagaggggccttcttggtgccagatacatgaggtggagctgacattctagtgggggacatagacgatagcctgataaacacaagtaaataaacacagaaatataataattatcgattgtagtaacttttgggaagaaaacaaaaaggtatttgaaatagaataatttggggcctgctttacagaggggcccaggaggccaactctgccaaggtgaccgtcgagcagcatctgaatgcagggagattggagccgtgtggccacctgggcagaacttcagttaccagtagtagtagtagtaggtgcaaaggcctatggtgcggagcagcgagaacaagaggaatcatgtgggcttcatggccctgtcttattctgagagaaacgggaagacagtggagcgctttgagtgaggtgtggcatcttctgatcattcgggctgctcctgggagttgagtagaagatctcaatccagcagaggtgatggtggctggggccagggtgttgtgatagaggtggttaaaatgggtcaaattatgggtgtatttgtaggtaaagccaacagaattttctgagagtctatatgtgggggtaagagaaacagaagagttaaggatgaagctaaggtttgtggcttgaactacaaacttagtaaaggagaaaacccagccggcggtggctcacctatagtcccagcacttttagaaaaaggttttactagaatttagatcgttcgtgattttaaaaaaaaaacaaaaacctttaatccaactgtaaataaaagagaattttcttaaatccctgcagatttcctgcaaataccatacctcaactaagccttgagagctttccctttacagtcaagaacaaaagcaagtcacttctagtccacgtagcatttgtagtcatggccaggtcatgagacaagaaaaagaaaaagttaaaaaaaaaaaaaaagaactggaaaggaggagatgaaactcattattcttagtcttctttaccagcatttatcaagatatttggacagagaggaataaacttaggtagtcagttttgccttctaaacctgggagtatttgctttccagctgagcaactccacaaaatttctcctatgttgatagatattttcatgtgttgttatacaattttttttttttttttttttgagacggagtctcactctgttgcccaggctggggggcagtggtgcaatctcggctcgctgcaacctccgcctcccaggttctagcaattctcctgcctcagcctcccgagtagctgggattacatgcccatggtgccacgcccagctaattttttgtattttagtacagacagggtttcaccatgttgcccaggctggtctcgaactcctgagctcagacaatctgcccacctcagcctcccaaagtgctaggattacaggcgtgagccaccgtgcctggcctgcattttttaaaaatattttttttcggcctttcattgagatttttgagagtgaagggggtaaacgtgctgcttgctatcttgttccagagattagcagtggttttctggtctttctttaacccctctttctctggtccctggctgcctgctcggtttcagcacagtagaaggatgtccgccctgtagggtcagtgcagcgagacctgggccaggaggtctccagccaccctccgggtacatgttcggttggttccagatcatcctgcctgacaggcaccagactgcacagtggctgagtccagcttgggactggccaagggcctcaagttagatctgcgtgtcaggaggatattgctggcagtttggctgtgagggagaggtacagtcagcgtggcagtttggctgtgagggaggtagtttggctgtgagggagaggaacggtcctcgtggcagtttggccgtgagggagaggtacagtcagcgtggtggtttggctgtgagggaggcagtttggctgtgagggagaggaacgatcagcgtggcggtttggctgtgagggagaggaatggtcagggtggtgggaagaatgggaggttaggagtttgttgtttttagttttaagatgaatgggctgtgagcccaccatcaagtgatggtgggcaggttccagtaggagggagaggccagccgttactccctgagttggtcactcgtgagctcggggtcagcaagaggcgatgcctgatgcagattcgaggagggatggtgggaagttgagggagagtttctgttggtggctggttcctgcccacctgctgtgagctctccagagcccaggaatcctggtggggattggagagcttggtatttctgagctcagggtctgcttcattctccttcttgcagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatgtgagtggcgtcttggccctgggcctgagggcaggccctggacctcctgagctggtgcctctgggggtccatttaggggggcccttctgacctcagagcctctgcccagccctaggctcctccctgcacccctaggatgaaatgcaggctctttccggcagacgccccacccaagggtccaccacaggcagcctcagctcagactcctgaggtgggtcctcctggagttgactccttcgtgaaaatgaagcagaaggctgactggtggaggtcagagaagaaaactccagaggagatgctgctgtttctgttggcaaggacgatagtagcactgctagctgctctgggttaggccctctgggaagtgttttattcctgttgactcctctcaggaacctgttgcacagatgatgaggctgacttgtggagaagctgactaactttctccagcccgaggaccatgggcagctgttgctgtgccacccctctagggtctctgttggagttgagggacagtagggctgctgggcctcccgtccccaggctgcccggcgaaggtggtgaaccgcggagcagggccgaggcccccaagaccttcctcggtcacgcagggattcttagagtggagcctgtggcttgtgcatttgtttccttcatgccgagtctgtctggtcctgtttcctctttggtctcctcgctctcatcaggatgccggcctgtctctgcagtttacggcagcctggatttggtggccatgattgaagttgagtataaggcttggggggggtgcctgatggcccagctccctcacgttgcctctgcctgggtcccttcttggtggagtctcccatccccccaccaccgactcttgagcagatctgcctctttataggaaggcctctgctgctgtctgtcccctctgtgagtcctgtgagctaccagggcatgagaataattaagttagtacttgaggggctgtggaaggtggagaagggtcaggcgcctgtgggtcaggaatctgggaggggtgctaggttttgagtaactagaggatgtgttcccctcaggtgctgtcagggtggggagggggccggagtgcaaggtgctttcacctagagcttgttacttgtgccctggggtgaagcttggtccacgtgtgcctgggagcctgtgcctctctccccagcctccagcagctgtgctcatgagggctggtggcatgatggtggacaggtcctggggagagactggggccctttgccctgtgcctcatgcgttcatggagatagggctgggcattcagcaggcatttgctaaatgcttattgagctcgtttatcaagcttcttgaacaggcagatggcagatgaggagttaaggaaaagccagcacagggtccatgtgaaccagattcctcctcgagtgggagtcgtgtctgatgacaggcttgtgtgattgagggaatgaggaacaggacaaagccggtgatgaggagcttggctgttctctctctgtagccaatcaaggaacaattcccacaaagacagaccctaaaaatagctctgagctggctgcattcctgctggccccacccaaatgaaggactgtgtgaccaggtctccacagccctcagtgtccactggggcttggccaggggccgcacatgactcagattcttctgcctgggtctctgcctcccgcaggaggggatgggcaggagccccatcctggggcaggcagcactggccaggaggggccacagaggtttcagccagcatgtgtttcagtaggacccagtgagtgctggctccgcttacacagtggtgagcagaggcattcgacacgtaagggcatggacagtggcgagtgccgtgaagaaaacagaagaggttgaggagcaggcagtgacgaggtacagggtactgggagggcaaggcctggtgaggtctagaaaccagacatgcagatgctacaacaccttggaagcttggccggggcagcaagatgcagtcatggcagtgcctggggctggcgccacacaaggccccagagcaggtagccaagaaccgaccagtccgctcctccacactaagggcatacagggtcggtcactggagattagacaggagttttgaagaggatcctttggagagagcgagagcccgcccctcacctccaacccagtgagagggacttttgtggcccctcggatatacgctccttcaagcaatgacatctgggttctttgtgggcggaagcccacggcctgcagtaggggtggaggcagagagatggaaagctcagtccgtgttgggagcaggagtgggggtgtgagcaacagcgggcagccaggaccgggtgagtgatggggtctcagagtggattgctgaaaagctggtggcagcgggtggggcagcgtgggggcactccagcttgaggagaaatggctttgtctgtgcctggaaaagcaggcggagtcaaatggagctttgggagaacacacggatgagcctggggagagacgagtcggcagtaaattcctgttaggtccagagaggtgagatcatctcaggacagcaccgcacgaggaataacagctgtcccttctccctcccctgctgtgatagtgctgggtacaggggagcaaagaggggccgtgtctttctcttccactgaaagcaaccagctgtggcaggccagccagcgagagtgggtattgtcatggtgaagcatgtcagtttgatggccagctgagactgagactggacactttcttttttttttgagacagagtcttgctttgtctcccatgctggaatgcgatggcacgattttggctcactgcaacctctgcctccttggttcaagtgattctcatgcctcagcctcctaagtagctgggattacaggcacgagccaccccatccagctaatttttgtatttttagtggagacagggtttcgccatgttggccaggctggtcttgaactcctgacctcaagtgatctacctgcctcagcctcccaaagtgctgggatgacaggcatgagccaccacacctggcctgaacactttcaactgccgagttgaaactgtattttccacttgaaagtggctgtagaacttcgccttacccaggagctgtcagaatggtcatgggcttgtccaaattatcatctaggggcatgggaaggatttctccaatgaccatgtttggaggcgcagtggaggtaaatcatgttgctttatgattatgcacgtatgctttgcttatgttcattgtactagttccgtgaagatccaagtttgaaagtgttcagatccatagctgcattttgatgctagcacaaacaggccttgctcatagagtggatgtgagagaaggagaagtctcaacgatgatgtgacttgaggcactgagaaaggtgatgccatttactaagaaagggagaatcgggagacacgaatttacttagttttgttatagcagagggtggtggcggaactccaggattctgttttggctctgcaaaactttagataactattttcatacaagtggagatcttgggtgtgtaggtgggtgtttgagagggaattcagagggaacagcaggctgatgagcatttgaagtacttgactcatggacagtgtttaaaactatgtgagaggatgagatcacctgggtaataagtgcagatggagaaaagaaggcccaaggctgatactggggagaattccagcactcagaggtccagtaggaaagcaggagccacgaaagagatggggctggagcttttaagggggcaggaaaaacaccacgaccacacagcatcccgggagcagagtaaagcgttcggagaacatggtcagcaccacggccgcgcagcatcctgggagcagagtaaagcgttcggagaacatggtcagcaccacggccgcgcagcatcctgggagcagagtaaagcgttcggagaacatggtcagcaccacgaccgcacagcatcctgggagcagagtaaagtgttcggagaacatgatcagcactgcagccgcgcagcatcctgggagcagagtaaagcgttcggagaacaccatcagcaccgtgaccgcacagcatcctgggagcagagtaaagcgttcggagaacatgatcaacaccacgaccgcacagcatcctgggagcagagtaaagcgttcggagaacctgatcagcaccacgaccgcacagcatcctgggagcagagtaaagcgttcggagaacacgatcagcaccacgaccgcacagcatcctgggagcagagtaaagcgttcggagaacacgatcagtaccgcgatcacacagcgtcctgggagcagagtaaagcgttcggagaacacgatcagcaccacgaccgcacagcatcctgggagcagagtaaagtgtttggagaacatgatcagcactgcagccgcgcagcatcctgggagcagagtaaagcgttcggagaacatggtcagcaccacgaccgcacagcatcctgggagcagagtaaagtgttcggagaacacgatcagcaccgcgaccgcacagcatcctgggagcagaataaagcattcggagaacatgatcagcaccacgaccgcacagcatcctgggagcagagtaaagcgttcggagaacatgatcagcaccgcgatcacacagcatcctgggagcagagtaaagtgctcggagaacatgatcaacaccacaccgcacagcatcctgggagcagagtaaagcgttcggagaacatgatcagcaccacgaccgcaaagcatcctgggagcagagtaaagcgttcggagaacatgatcagcaccacgaccgcacagcatcctgggagcagaataaagtgctcggagaacatgatcagcaccgcgatcacacagcatcctgggagcagagtaaagcgttcggagaacatgatcaacaccacaccacacagcatcctgggagcagagtaaagcgttcggagaacatgatcagctgggccagatgttgctggaggtcaaggaagatgggaagcccggactgttgcgtttgataagaggaaggttgttggtaaacttggcaagggcggtctcagtggtgggacaacgccctggaatgcgtgggttacagggaggaggaggtgaggaaatcagggtggcaaccgcagatgactcttggagggagcagagcagtgggaagtaactgcagggagacaggggttaagggaatgggcttttaaaaaattaaacttttaatttaagataattgtagattcacatgcagtagtgagaaatacagaaatagctcatgcatcctttacccttttctcccagtggtgacaacctgcaaaactatagtcagggtcacagttaggatattgatgttgatacatcagtatcaatgatgttgacacagtgaagacgtagagcatctccatccctgcaggggtccctcctgctgcccttttgtggtcacacccgcatctctcctgccctcgccccctccttaatccccggcaaccactaatctgtttgccatatctataatttagtcattttgagaatgttacgtggacaaaaccacaccaaatgtaaccttttggtactggctgctttcactcaaacaaaattctctggaggttcacccaggtgttggtagcatgtttccttttactgccaggtagtattgagtggtgccaggtgtcaatttgtggtgccaggtagtattccgtggtgccaggtggtattccgtggtgccaggtggtattccgtggtgccaggtggtattccatggtgccaggtggtattccgtggtgccaggtggtattccatggtgccaggtggtattccatggtgccaggtagtattccgtggctccaggtggtattccgtggtgccaggtagtattccgtggctccaggtggtattccgtggcaccaggtggtattccgtggtgccaggtagtattccatggctccaggtggtattccgtggctccaggtggtattccgtggtgccaggtagtattccgtggtgccaggtggtattccctggtgccaggtggtattccgtggtgccaggtagtattccgtgctatggctgtaccatggcttgtttaaccgttcacctgtggaagcttccaatttggggttattatgaatagagttgctgtacacatttttgtgcaaacataagttttcatttctctgggataaatgccaaagagtgcaaatttctaggtatagtagttgcatgcttagttttttaagaaaccaaagcttttccagagggctacactcttttacatttccaccagtggtgtgtgaatagttcagtttttgtgcattctggccagtgtttggtggtgacacttttttattttagccattctgataggggtatagtgacacatcactggttttaattcgcatgtcctaacagtgagtggtgttgagcatctttctggacttatttgccatctgtgtatctttggtgaaacgtctcttcacatcttttgcccatgttctgtttgaattgttctttatatattctaggaactggttctttgtcatatatatggtttgcaaatattttctcctagtcagtagcttatcttttcatacttttcacctggtctttcatggaacaaatgtttttaaaatttgatcgagtccagtttatcaatttatccttttgtggattgggcttttggtgtcaactgtaagaactctgcctagtcctgaatcctgaagattttctttttttttttctaaaagttgtattgttttatattttacatgtaagtttacaatctattttaggttaataaaagtgtgaggtttttgcctgcctgccttccttccttccttctttccttcctccctcccttccttcctccttccctccctccttccctccctctttcccctcctccttccttccctccctcccttccttcctgtagctccaacaccccttgttgaaaaggctgtatttcctccattgaattgcctttgtacctttgccagaaatcagctggacatatttatgtgggtctatttcaggtccacgtgtctttctctctgccaataccacgtagtcttgcttattgtagttacctatatgttttgaagtcaggttagactgattctttccatgttattcagtttgggagaattgacatcattactatgttggatgttccatgtccaatcagaacatgttatttctcttcatatatttagatcatgtttgatttctttcattagcattttgtagttttcagcatacaatatacattttgttagatttgtagctattatgttttcttattttctttgaatgattctaatgtgttttgagcacccctggagaaactggtgttctagtactagagtgtccagcaaccctgccctcacaggggatgaaaggaagcggaccttggtgttgacagtgtacccttcatgggatacttggattacttggcaggcagccagtgcctggttgtcccgcctgtgaccagggggttcctgatacaggaagcttgtttatactggcagacatccttgtggctcttgtccgacccgtgtctggtttgtgcctgaccagcattgcagtgttgggagcccatcctagttccccagggaaaacctggccaagggtagccctggttcttcagatggaaggcacacattcagtcaccaccacaacaggaaataagttcaacgatgtattacctacagatcggcagggagggcaccgtgagtggggagcgccatcctccctccccaggttatctgaggcagtaatgaagagtcagagaggtatagggggaggcaactggccatgctagggaatagggtgtgggtccctttaaatttgtgggcgaatgcctgaatggtctgtttaaaggaggcagcagaaatgtgtagtctgctaggtgggagagatgcctctaagttcttatctctggccacgttttgggtgtggtgttctaacacctaggcagcaacctttgctatgttgttcccattagaaaatggtattgtattttaaatttcagtgtccatgtgttcattgctagtatatagaaatacaatggacttttgtatgttgatcttgatcattcaaccttaccaactcccttattagttctgggagatttttttgtagattccttgggatcttctatgttgataatcatacaatttgcaaacagaaacagtttatttcttcttttggatctgcttttttttttattgtgctaaaataccgataacataaaatttaccatcgtaaccatttttttttttttgagatggagtcttgctctgtcgcccaggctggagtgcagtggtgcaatctcggctcactgcaagctccccctcccaggttcatgccattctcctacctcagcctccggagtagctgggactacaggcacgcgccaccatgcccagctaagttttgcattttttttttttttttttagtagagacgggatttcgccatgttggccaggatggtcttgatctcctgacctcatgatccgcccacctcggccttccaaattgctgggattacaggcgtgagccactgtacctggcttccttttttcctttcttttttttttttttttttgagacggagtctcactctgtcgcccaggctggagtatagtggcactatcttggctcacttgcaagctctgccccctggattcaagcgattctcctgcctcagcctcccgagtagctgggattacaggcacctgccacagtgcccagctaatttttgtatttttagtagagatggggtttcactatcttggccaggctggtcttgaactcctgacctcgtgatccacctgcctcagcctcccaaagtgctgggattacaggtgtaagccactgcgcccagccacctccttccttcttaaggctgagtaatattccattgtatgacattttgcttatccattcctctgtcaatggaccattgggttgcttccatgttttaactcttacgaagagtgctgccatgaacatggttgtataaatatctctttgagaccttgctttcaattcttttgggtatatacccagaagtggaattgagggatcatatgataattacatttttaagttcatgaggaactgctgtatcgttttgcacaatagttgtaccatttgacattcccaccttttggtgggaatacacatgcatttccatttctgcacatcctcaccaatacttgttaatttctgtgtttttgatagtagccattttaatgtatgtgaggtggtatctgcttgtagttttgatttgcatttctttaatgattagtgatgttgagcattttttcttgcacttattggccatttgcatgtcttctttgaagaaatgtctgttggagttccttgcccatttttgaatctgttgttttggttgttgttgagttttaggcattctctgtatattctgagtataatccttttcagatatatgatttacgattttctcccattctatgtgtgccctttttactgaattgatggtgtcatttgatgcacaacattttaaaattttcatgcagtctagtttgtctgttttttcttttgttgcctttacctttgatgtcatatccaagaagtcgctgtcaaatctaatattgtgaagcttttgacctatgttttcttttaagagttttactttttttaggtctcacattcaggtctttgatccattttttatttaatttttgtatatggtgttagataaggatccagctttcttcttctttttttttttttttgagacagagttttgttcttgttgcccaggctggagtgcaatggaacccgcctcctgggttcaagtgattctcctgcctcagcctcctgagtagctgggattacaggcatctgccattacgcctgtctaatttttgtatttttagtagagacggggtttctccatgttggtcagactggtcttgaactcccgacctcaggtgatccgcccacctcggatttgctgaaaagactgtccttttaccataaaatggtcttgacgctcttgtcaaaaatcatttggccatatatgcaagagtttattttgggactctgtattctatccccttggtctgcgtatctcgatctatgtgcgtagccttatggcactggctagaaacttcagcattatgttgagtaagaatggcgagagctgacatatttgccatgctcccaatcttaggaaaaagcatttgatctatcacaattaagtataatgttagctgtacggttgagttgttgttttttcttttgaggtagatgctgtttatcaagttggggcagttctactctattctattcttacttttctgagagtttttgttttgaatgggtgttgaattttgtcacatgtgttttctgcactgatatgatcatgtgagttttcttctttagtctgttaatatggtgaattacattgatttttgaatattgaaccagccttgcattcccagaataaatcccacatggtcatggtacctaattctctttatgtgttgctgaattgtatttgttagcatttttactaaggagtcttacacttatattcatgagggattttgatctgtaattttcttgtctttttttgttgttgttgttgagacggagtcttgctgtgtcaccaggctggtgtgcagtgttgtgatcttggctcactgcaatctccgcctccaaggttcaagggattcccctgccttagcctcccaagtaggtgggactacaggcacccaccaccacgcctggctaattttttgtattttagtagagacagtgtttcaccatgttggcctggatggtctcgatctcttgactttgtgatctgcctgcttcaacctcccaaagtgctgggattacaggcgtgagccccaccgtgcctggcctatgattttcctttttttgtattgcctttgtctggttttggtatcaaggtaacacaagcttcataaaataaatcaggaagtatttattcctcctctgttttctggaagagattgtatagaaatgtgttatgtcttttaaaaacgtttggtaggattctactgtgaaactctctgggcttagaaatttctttttggagatcttttttttaaataacacttttgctgcaatataatctgtgtaccataaaattcaccattttaaagtttacagtttacagttcagagttttttgtatgttcaaaaagttgtgcagccatcattgttatctaattttaagcattttcattaaccaaaaaagaagccctgtatccatgagccatcagtccctatttccttattcccacagcctctggcaagcactaacctttctgtctctgtagatttgtctattccagacattttatataaatggaatcatacaatcggtggccttttgtgtttttacatccacgatgaagcaagtattggtatttttttgtcaagtatgattttgttgtgtatttatagcatattttatttatatttcatgagttgatggacatttagatatttccacttttaaaaattatgactaatgctgctatgaacattcttgcacaagtttttgcaaggaatatgttttcatttctcttgggtatggacctaggattggaattactggatcatagaactctgtgtttaaccatttgaggaaccaccaaactgttttccatagtggcagtaccattttatatttataccagcagtgcacaagggctccagtttctctgcatccttaccagcatttgttgtctgtctgaaattttaaccatcaggccaggagtggtggtttatgcctataatcccagcactttgggaggctgaggtgggaggatcacttgagcccaagaatttgagaccagcctgggcaccatagcaagaccctgtctctacaaaaacattaaaaagttagccaggcatggtggtgtgtgcctgtagttccagctactcgggagactgaggtgggaggatcacttgagcccaggagctggaggctgcagtgagccaggatagcgccactgcactctagcctgtgtaacagagggagaccctgtctttaaaacagtaataataaaactaaaaaataagacaattttcaccatcttagtgggcatgaagtggtatttctgttcagttttgacttgcatttctaaagtgacttatttttatttttgggacagggtcttactgtgtcactcaggctggagtacaggggcatggtcatagctcactgtagcctcaatttcctgggctcaagtaatcctcccacctcagcttgggagagtagccaagaccacaggtgcacactgccaagcctggctaatttttaaattttttgtagagatgaggtcttcctgtgttgcccaggctggtctcaagctcctgggctcaggcgattctccctcctcagcctccgaagtagcaaggaccacacgcgcatgctaccatgcctggctaagtttttaaaactgtttttttttgtagaggtggggtcttgctatgttacccagactggtcttgaactcctggcctcaagtgatcctcccaccttggcctctcaaagctctgggattacaggcatgagccaccgcatgcagccattgttgagcatcttttatgagcctattcatcacttgtatatcttctttgaagaaatgtcagctgggcgcagtggctcacgctgggggtttagatgattatttagacttccttcttttgtgaggtggacatgtaggtctatatgttttcctctggcactgctttagctgtgtcctgcaatttgatgtgttgtctcttcactttcattcagttcaatgtatttttaaattcccttgaaatttcctctttgacctatgagattattatatagaactgtcttgtttactttgtgtttggagagttacctgttatctttctgttattaatttctagtttgattctattgtggtgggagaatacactaaactgaaagaattttaattttaaatttgttgacgtttgttacatggctcggaatatggtctattttgatatttattttgtgggcacttggaaagaatgtatattctgctgttgtgtgctgcatgtacagatgttgattgattcttttggttgatggtgttgttgagctcttttatatccttgctggttttctgtctattctacaaattgttaagagagaggtgtagaagtctccagctttaattgcagatttgtctgtttctcttttcagttctgtcagtttctgtatcacttattttgcagctctgttgttgagtatacacatatttagacttgctatttttttttgatggattgacctttttatcattatatacatgtttccctgtgtctcgggtaattttgttttactgggaggtttgctttatctgatattaatctagccactccaatttaaaaaaattaatctttgtataaatctttttttatatttttacatttttttggagacagtctcactgtcacccaggatggagtttagtggtgtgatggtgtgcaatctcagctcattgcagcctcacccttccacactgaaggaatcttctacattagatggtattatctggggagggtcttgactacgagttgtccaggttcttggcggtttgaacaaagaattgcacaagatgcacaaagcaacaaaggaatgaagaaatgaagaaatgaaagcacagatttattgaaacaaaagtacattccatagtgtgggatcgggctcgcgtaaacggctcaagagccctggttacagaattttctggagtttaaatactctctagaggtttcccattggttagctgcttacaccctgtgtaaatgaagaccaggccctctaccattctgattggtcatgggaggcgaccaatcaggtactttccatttttcgtctgcgatacagtggaatggggggcgttgcaaagggagtagcctcttcttttgttacttggatgtggagaggtggagttttccttttgatttagttctaggaagtcagcacaaatcggccttaggttccttgcctccagaccctattctcctgcctcatttcccccgagatgtgatccccatcatctttataggaggccgagggactgatggttttttcttcagtaactgcttcatgctgatttgggcacagttcctacctattggggatcatggaactctcaccctgctctgtctagtggagacatggtagttgctggatggccaggggtggtgtctttacctggaactggctggaaaccttgtctcatgatcatctgaagcttgatggtctctgggcgagaggaaatgaatttgtttaagagatttaatgaacatggtccaaaaaccaaggcaaatatagtcattagtgatgggccggctagaggaaggagccatgcacctcaacttagcatttctgaccaggagccccatgactcagacagctgttgtcgtatcttaggggcccagtcagctaatttccaggcggcatcccttactaatcctgattagttgacataaaaacagcatttttcctctagaaaaagacataagccacctttttaagcagttaggagatccagtccccttcaattctgtaaagtgactgctgccaaggagtctgtctgattttgtatggcgacgatactttgggcagtgtcttctgagctttccataaaatctctggacaagttagtgataggatagggagattgcaagcctgctaactcccgtttctactcttgctgttcttcctaacccaaccaaaaggggtgtgagttggatggctcatttgtgtctggtggttgcagttaaaggtatagtgaagaattggttgttgggagctacattaattttgggagctaaataacaagttacaggttccagtccagttggctggtaaatctaagtaggaactggtcccgcacgggaaaaaggctccttgtttttcaagacagaacttgttttctatggtgaacacatgggctagcttgttgttttcactttcccatatggttgaggtctttgctaaggtggccctggttaaaggctggaaaggatcttgggaagtatcttgagttgccccagcagttctcttttcccagtggaggtagttaggcttagtgtccagtaacaatcacccagaggtattttcatactggggaaccaaaaggcaactagacgtctcaggattagtacattcttcacaagggaaaccgtgaatgcagctagtgggcctgcctcgaccatacttaggctgtccatcctttaaagcccttaaccagggatggtttccatgaaaaccgtacaggttatctaaatgatgcggtttgggtaactgtatagcttacgtaatcgagtgaaggattaacttccagggtgtagttgcattgatgactttattttatctttacttttatttatttatttatttatttattatattttttgagatggagtctctctctgtcgcctaggctggagtgcaatggtgcgatctcagctcactgcaacctccacctcccaggttcgagcgattcttctgcctcagcctcctgagtagctgggactacaggcgcgtgccaccacgcccggctagttttttgtatttttagtagaaatggggtttcactgtgttagccagaatggtctcaaatcttctgacctcatgatctgcctgcctcggcctcccagagtgctgggattacaggtgtgagttttttgtatttttagtagaaatggggtttcactgtgttagccagagtggtctcaaatctcctgacctcatgatctgcccgccttggcctcccaaagtgctgagattacaggtgtgagtcaccgcgtccggcacattgatgacttttcaaggttccaaggaccggaccagaattttcgcttctgttaatacaaagtggcacctgcaattttagctctgtgtacatttatattgggccccaaattggtttctgaggggatgcaactccagaaaggttgctcagatgggattggagtaggtttactgcttatcctgtcattgtaacccttgtcatttccatgattttgaattcatgtatgtcatccaggctcattagtttgaagagagttcctcctttgtagttagggtgataggtcatttccttaagggcccaagattgggctgggatcaggatggcagtatatttagatgatgatggagataaacaaaaccaacagtcctttgccagggctgggctggtggtatttaagtctttgtgttaaatttaaagttcttaataaatacccagaatccactaattgctggaggggtaaagggaagctctgttgtgaaataaagctgattgctagtaagacatggttcctgtatacacaggctgtgggtgaccattatggaacaaaaaaaaaattacttatttgttattttgtcctatagaatgggaacttcagggggtggatacctatgctgtcaggaatgcttgttataaaaatgaattgaaacactttggttaattattacaaaggaagtgattccatccattttgaataaaacaaattgtaaaaatataaaaaatagctaccaatatccagcttacgataagtatgcaacaaagacaccaaggaaagttggtaggcatttacttatttttcggctgtcttttaaacaggtacttcactgttcccacaggttcacaggtgtagtggctgataggagcttcaggttccaggtccagggcttcagttattgcaggcttgaccctggaaagatggatccaactacctaatcctagtactttgaccacagaaggcttgtccagcaccactgaaaatggtcccttccatttgggttgcaatagttgagcaggtgatccctctttccatgttttaacaagtacctgatttctcattttggagatcatggcagacgggaggcaggactagattgcagttcccactcggatggccagagcagcctgtggaggattgtatcgtgaacttttgctccagaatgactgcagaaataaatcaggaaagccgagagaacccatagaccctctgaaggaagcggattgctccagcaggacctgggagatacccaaaatactgtgctggtatccacagctgagagacccacagacagttcatatcacaggactctgtgcagacaacccctagtaccagcccagaacccggtagacttgctggatggctagatccagaagagagacaacaatcactatagctcagctctcaggaagccacagctctaggaaaatggggagagtactacctacatcaagggaccaccccatgggacaaaagaatctgaacaacagccttgagccctagaccttccctctgacagagcctaccaaaatgagaaggaaccagaaaaccaactctgacaatatgacaaaacaaggttccttaacaccccgaagaaatcacactagctcactagcaatgggtccaaaccaagaagaaatcccggatttacctgaaaaagaattcagaagattagttattaagctaatcagaaggcaccagagaaaggcaaagcccaatttaaggaagtcaaaaaatgatacgagaaatgaggggataaattttcttttttttcattatactttaagttctagggtacatgtgcacaacgtgcagatttgttgcatatgtatacctgtggcatgttggtttgctgcactcgttaactcatcatttacattacatatttctcctaatgctatgcctcccccataccccccaccccatgacaggctccggcgtgtgatgttccctgccctgtgtccaagtgttctcattgttcaattcccacctgtgagtgagaacatgcggtgtttggttttctgtccttgcgatagtttgctcagaatgatggtttccagcttcatccatgtccctacaaaggacatgaaatcatccttttttatggctgcatagtattccatggtgtatatgtgccacatttttctaatccagtctatcattgatggacatttgggttagttcttagtctttgctattgtgaatagtgccacaataaacatatgtgtgcatgtgtctttatagtagcatgatttataatcctttgggtatatacccagtaatgggatcactgggtcaaatggtatttctagttctagatccttgaggaattgcccactgtcttccacaatggttgaactagtttacactcccaacaacagtgtaaaagcgttcctattgctccacatcctctccagcacctgctgtttcctgactttttcttttttttttttgacggagtctcactctgttgcccaggctggagtacagtggcatgatctcggctcactgccgcccaggccggagtgcagtggcacgatcttggctcactgtcgcccaggctggagtgcagtggcacgatctcggctcactgcagcctctgcctcctgggttcacgccattctcctgcctcagcctcctgagtagctgggactacaggcacctgccaccacgcccggctaatttttggtattttttagtagagacggggtttcaccgtgttagccaggatggtcttgatctcctgaccttgtgatccgcccgcctcggcctcccaaagtgctgggattacaggcgtgagccactgcgcccggctgtttcctgactttttaatgaccgccattctaactggtgtgagatggtatctcattgtggttttgatttgcatttctctgatgaccagtgatgatgagcgttttttcatgtgcctgttggctgcataaaggtcttcttttgaaaagtatcctttgcccactttttgatggggttgtttgattttttcctgtaaatttgtttaagttctttgtgcattctggatattagccctttgtctgatgggtagattgcaaaaattttctcccattctgtaggttgcctgttcactctgatggtagtttattttgctgtgcagaagctctttagtttaattagatcccatctatttcggcttttgttgccattgcttttggtgttttagtcatgaagtccttgcccatgtctatgtcctgaatggtattgcctaggttttcttctaggatttttatggttttaagtctgacatttaagtctttaatccatcttgaattaatttttgtataaggtgtgaggaagggatccagtttcagctttctatatatggctagccagttttcccagcaccatttattaaatagggaatcctttccccatttcttgtttttatcaggtttgtcaaagatcagatggttgtagatgtatggtgttatttctgaggcctctgttctgttccattggtctgtatctctgttttggtaccagtaccatgctgttttggttactgtagccttgtagtatagtttgaagtcaggtagcgtgacgcttccagctttgttctttttgcttatgattgccttggcaatgtgggctctttttttggttccatatgaactttaaagtagttttttccaattctgtggagaaagtcattggtagcttgatggggatggcattgaatctataaattaccttgggcagtatggccattttcacaatattgattcttcctatccacaagcatggaatgttcttccatttatttgcgtcctcttttatttcattgagcactggtttgtagttctccttgaagaggtccttcacttgagggggtaaattttcaatgaaatagagtgcataaataaaaaacaataaaaacttcaggaaacaatggatgcacttagagaaatgtaaaatgctctggaaagtctcagcaatagaattgaacaagcagaagaaagaacttcagagctcgaagacaaggtttttgaattaacccaatctaacaaaggcaaagaaataagaataagaaaatatgaacaaagcctccaagaagtctgggattatgttaaacgaccaaacctaagaataattggcgttcctgaggaagaagagaaatctaaaaatttggaaaatgtatttggggaaataatcaaggaaaacttccctagccttgctagagacttagatgtccaaatacaggaagctcagagaacatctgggaaattcattgcaaaaagataatctcccaggcacattgtcatcatattatctaaagttaagatgaaggaggctgggtgctgtggctcacacctgtaatcccagcactttgggaggccaaggtgggcggatcacctgaggttgggagtttgtgaccagcctgaccaacatggagaaaccccgtgtctactaaaaatagaaaaaattagctgggaatggtggtgcacgcctgtaatcccagctactcgggaggctgaggtaagagaatcgcttgaatttgggaggcgaaggttgtggtgagccaagatcgcaccattgcactccagccggggcaacaagaatgaaactctgtctcaaaaaaaaaaaaaaaaaaaaaaaaaaaaaaagacaaaggaaagactcttaagagctatgagccaaaagcaccaggtaacctataaaggaaaatctatgaaattaacagcagatttcccaacagaaacactacaagctagaagggattggggctctatcttcagcctccttaaacaaaacagttatcagccaagaattttgtatccagcaaaactaagcatcataaatgatggaaagatagtttttttcagacaaacaaatgctgagagaattcgctactaccaagcaagcactacaagaattgctagaaggagctctaaatcttgaaacaaattttcaaaatacaccaaaatggaacctccttaaagcataaatccaacaggatttatataacaataacaattttaaaaacccaaggtattcaggaaacaagtagtatgatgactagaatagtatctcacatctcaatattaatgttgaatgtaaatggcctaaatgctccacttaaaagatacagaatggtggaatgcataaggattcaccaaccatctgctccctttaagagactcacctaacacataagactcataaacttaaggtaaaggtgtggaaaaagactttccatgcaaatggacaccaaaagcaagcaggagtagccattcttatatcagacaaaacaaactttaaagcaacaacagttaaaaaagacaaagagggacattatataatgataaaaggccttgtacaacaggaaaatatcacaatcctaaatatatatgcacctaacactggagctcccacatttataaaacaattactagtagacctaagatatgagatagacaggccaggcacagtggctcatgcctgtaatccagcactttgggaggccgaggtggatggatcacctgaggtcaggagcttgagaccagcctggccaacatggtgaaaccctgtctctactaaaaatacaaaatagccaggtgtggtggcaggctcctgtaatctcagctatttgggaggctgaggcaggagaatggcgtgaacccagaggtggaggttgcagtgaggcaagatagtgccattgcactccagcctgggtgacagagcgagattctgtcctaaaagaaaaaaaaagagagagaaatgagatacacagcaacacaataatagtggggaacttcagtactccactgacagcactaacaggtcatcaaggcagaaagtcaacaaagaaacagtgaatgtaaactataccctggaacaaatggacttaacaggtatttacagaacattctagccaacaactacagaatatatattcatcagtgtatggaactctcttcaagataaaccatataaataggccacaaaatgagcctcaataaatttaagaaaattgaaattatatcgggcaccttctgagaccacagtggaataaaactggaagtcaactccaagaagaaccctcaaaaccatgcaaatacatggaaattaaataacctgctcctgaatgatcattgggtcaaaaaatgaaatcaagacggaaatttaaaaattcttcaaactgaggccggatgtggtggctcacacctgtaatcccagcactttgggaggctgaggcaggtggatcacgaggtcaggagatcgagaccatcctggataacatggtgaaaccccgtctctaccaaaaatacaaaaaaaaaattagctgggcatggtggcaggcacctgtagtcccagctactcaggaggctgaggaaggagaatggcatgaacccgggaggcggagcttgcagtgagctgagatcacgccactgcactctagcctgggcaactgagcaagactccgtctcaaaataaataaataaataaataaataaataaataaataaataaataaaaaaaaataaaattcttcgaactgaatgacagtagtgacgcaacctaccaaaacctctggaatacagcaaaggcagtgctaagaggaaagttcatagccctaaatacctacatcgaaaagtctgaacgagcacaaacagacaatctaaggtcacacctcaatgaactaaagaaacaagaacaaatcaaacccaaacccagcagaagaaagagataaccaagatcagagcagaactaaatgaaacttaaacaaaaaaacacaaaagataaatgaaacaaaaagctagttctttgataaggtaaataaaattggtagcccattagcaagtttaaccaagaaaaaaagagagaaaatccaaagaagctcaattagaaatgaaatgggagatattacaactgacaccacagaaatacaaaagatttttcaaggctactgtgaacacctttacccatgtaaactagaaaacctagaggagatggataaattcctggaatgatacaacccttctagcttaaatcagggagaattagataccctgaacagaccaataacaagcagtgagattgaaatggtaataaaaaaattaccaaccaaaaaactccaggactagatggattcacagtagagttctatcagacattcaaagagaattggtaccaatcctatcgacactattccatgagatagacaaagagggaatcctccctaaatcgttttatgaagccagtatcaccctaatatcaaacctggaaaggacataaccaaaaaagaaaactacaaaccaatatccctgatgaacatagatgtagaaatcctcaacaaaatactagctaactgaatacaacagtatatcaagaagataattcaccatgatcacatggttttcataccagggatcagggatggtttaacatactcaagtcaataaatgtgatacaccacataaacaattaaagacaaaaatcacatgatcatctcaatagatgtggaaagaaccttcgacaaaattcagcatcctttatgattaaaaccctcagcaaaatcggcatacacaggacatacctcaatgtaataaaagtcatctatgacaaacccacagtcaacataatacagaatggggaaaagttgaaagcattccctttgagaactggaagaagacaaggatgctcactctcaccactcctcttcaacatagtaatggaagtcctaaccagagcaatcagacaagagaaagaaagaaaggttatccaaattgggaaagaggaagtcagactgtcgctgtttgtttgctgatgatatgattgtttacatagaaaaccctaaaaactcctccagaaagctcctagaactgataaaagaattcagcaaagtttccagatacataattaatgtacacaaatcagtagctcttttatatactaacagtgaccaagctgagaatgaaatcaagaactcaaccccttttacaatagctgcaaaacaaacaaaaaacagaaagccaaaaaacttaggaatatacctaaccaaggaggtgaaagacctctacaaggaaaactacaaaacactgctgtaagaaattataggtgacacaaacaaatggaaacacatcccatgcttatggatgggtagaatcaatattgtgaaaatgaccatactgccaaaagcagtctacaaattcaatgcagttcccatcaaaataccaccctcattcctctcaaatttggaggcatcacattacccaacctcaaactatagtataaggccatagtcaccaaaacagcatggtactggtataaaaataggcacataggccaatgacagaatagagaacccagaaataaacccaaatacttacagcaagcaaaaagataaaagtggagaaaggacacactattcaacaaatggtgttgggataattggcaagccacatgtaggagaatgaaactgaattctcatctcttaccttataaaaaatcaactcaagatggatcaaggacttatctaagacctgaaactataaaaattctagaagataacattggaaaaacccttgtagacattggcttaggcaaggacttcatgaccaagaacccaaaagaaaatgcaacaacaacaaaaaagataaatagctgggacttaattaaatcaaagaacttttgcacagcaaaagaaacagtcggcagagtaaacagacaacccacagagtgggagaaaatcttcacaatctatacatctgagaaaggactaatatccagaatccacaatgaactcaaacaaattagcaagaaaaaaaatcccatcaaaaagtgggctaaggacatgaatagacgattctcaaaagaagatatacaaatggccaacaaacatggaaaaatgctcaacatcactaatgattagggaaatgcaaatcaaaactacaatgtgataccagcttactcctgcaagaatggtggtaataaaaaaatttaaaaataatagatattggcatggatgcggtgaacagggaacagttgtacactgctggtgggaatgtaaactagtacaaccagtatgggaaacgatgtggagattccttaaagaactaaaagtaaaactaccatttgatccagtaatttcactagttggtgtctaccaagaggaaaataagtcatatgaaacagagacttgctcacgcatgtttacagcagcacaatttgcaattgcaaaaatgtggaaccaacccaaatgcccatcagtcaaccagtggataaagaaactgtgatatatatatgatggactactactcagccataaaatggaatgaattagtggcattcacagtgaccttgatgagattgggactattattctaagtgaagtaattcaggaatggaaaaccgaacgtcgtatgttctcactcataagtgggagctaagctgtgaggatgcaaaggcatgagaatgacacagtggactttggggactcaggaagaaagggtggggtgagagataaaagactacaaattgtgtgcagcatacactgcttgggtgataggtgcacgaaaatctcataaatcaccactaaagaacttacgcatgtaaccaaacaccatctgttccccaataacctatggaaataaatttttttttaagtaccttatctcctggcctgattttgggttgctggttagttgccagtgtggggagtctttgagtttcaaactttttttttttttttttgagtttcaaacttttgtaaagcctgctgaaatggtcccaggttaactaggtatttcactaaagtggctgtttctggatcagtatttagatcattagttaaaaatggcctcctatataacatttcatatgggctcatattaatttttgctctggggaaattatggactcttacgagagctgtggacagcaagttgacccaagtttctgatgtttcctgacatagcttagctaacacccattttagagtttgattagctctttccacttttctagaggattgaggcctccatgctgaatgtaaatagtatttgattctgagagccttagcaaccccttgaattatttgagagataaagaacgagtcattatcactttggaggctttgaggtaacccaaactcgggaaatagttctttgaagaaccttcacaacttcattggccttctgtgttttggtgtagggtaagcttcaatccagccagtaaaggtatctgtaacctgcacggaccttgggggactgaacaaaggatgacgaatgcgggaataaagataaagacaaagagtatatttggaagaaggggtcagggggctccttgcttctagtgaacaagggccctgagctttacacagccctccgtatttattaggcaaaagagatagcgagaagaggagggggtggttgtcagcaggcagtttgattcacagcaggcttgcaagaccgcattctttgaacaataggctctagatgtcccagtaggtaaccgcaatgagcacggtgccagggagtgattgccctcagcaaacctcctggttgcaggcacagtcatgagtttgcccacatcctgctttcatgataaacaagtttgctgtttgatcatataacctccagtggaatactgagttggtcatgtctctctggccttcagctccctacaggtgtctattagtactaacaaatcttgtatcctctacaggctggcattgtccttatggccctttgggtttcctttgcgtgctctttgggcattcagggcattgccagtgatggctgtcataatttttgcttgccatttttctttactctgttccccttttccttccttcatgattgttatacatcatgaaagcaatatcaagaagctgattttgattagtttgtgggcccatctgtagcttttggagcttatatctaatgtctggggcagattggattagtatattttttaaaggcttcctccagtctgccatgaaacatggctggattttctttcttgcccagtgtaacttcctttaccttatcataatttactgccttattctctttctcttcctccaaggagagcctcaagaaacttagcctggtggttcattccctcgggtgtgttatagtcccaattaggatcagtaatggagattatgtctgggcctaagtgattgccctgagagtttcaaggaaataagtcatctgcttcctggcgggcagcctcaaagatttgtttcttttccaaggggctgcaataggttgctagaatgaattgaacatctcccctgagagatcaaaggctaaggtcaaagtttgggacccatctccaaattcctagggttctcagaatagcttcctagcttttctgtatgttgttttatatcagttatagaaaagggggactgcactaggactggcccctcagctcctgctacttccctaaggggtagcagggctggagggggagattgtttctctccaaatatgaggaggacttagctggaaccccgaattttgctcttgggtttgagcctcaggagcacttggcaaggagttatacaggggtggttgcacttccctctgagagacaggtggcctttgtaaaagggggtcatctacaatatctagttctgccttaagaccttccttttcagggcaggttccaggacttttgcagattgttgggttttggtatagggccatgaagacctgtacgtatgggatttctgacaatttaccctgccttttgcaaaacaggtctaattgcaggatggtgttgtaattaagacttcccatgaccaccaattattcctggctgtccagctgatattggggctatacagtattatagtagaaaatcagacgttttctccttagattgtcagggttcaactgattccagtggttgatgatgcagccaagcagggaatcagagggaatggatggagagttgcccacagtggtctggaagagagaagaggactttcaaaagtggaggtcctactaggtgacccagattttacctggggtggccatctggaaaaactctgggtcttgtctgcggttcccaagggcatccccacctctggggccccatcttagtttgtcagatatgtctgaccttagatgggtgccagcaccactttggaacggttcccttcacaatcagtggcccactatgagtttcctcttgtccctggctgaaggccccgacttctagcatccttataatttgataaggccaagcttttaacttcagccaatatgttcatacacagaatctcttttacaattaattttcataagcctacaacttgttcaaacctttggatttttcctataccacttaaaacaatcctttaaccctctaaacttaggcaacataaattatacaacatttcttgcataatttcactttcacaaatctttttcacgacttacccagatcatctacgacatgcttggactttgttacttgtcctaaacatccctattttatttctttacttttattattattattatcatattccaggctggagtgcagtgatgccatcacagctcactgcaacctccgccttccaggttcaagcaattctgctgcctcagcctcccaagtaactgggacaacaggcgtgcatcactgtgcctggctaattttttttatatttttagtagagacagggtttcaccatattggccaggctggtctcgaactcctgacctcgtgatccacctgccttggcctcccagagtgctagcattacaggtgtgagccactgcacccagtcatatccctcttttaaaacaacagtcattttactttaggacaagaatttaccatacaagatgcctttttatataatataaaatctcttttatgtataaacttctttgcatagctagggggctaagtgggtttcttttgtccttagccagtcgaatagatcaagtaagagaaggggtcaaaatgcctaggagacattatcttttgtctttactagctaactctacaggagaatttagcataagaaaagagggtttaagttccctgaaatgtgtgaattcctccttgacaagctgccactgccaattgtgtcacacgtagggatcagggagtataaccaggaaagacagaaaagagtccttcccccttccaggcagggcagctatccctatcattcctcggccttcaggtaacactggagagtggccccagcaagttgccctcagttactggggagctactaggaaatgactgctgaaaaactgagaaaaaaaaaaaaagggaaaggactcaggtccctcatgtgaaccaggcagtggtggtcaggtgcttccatatggatacctttcagtctctccgtagagtggccccagccagagacctgcagttgcctccatgcttaggtgctctctgtcaagtgtcctgagttggaaagagagacagaaaatgcttcccctgtatggagcagagaggaaaagggaaaatgagaagaaaaataactcccaaactttgggcttgcctcctggctggcttgccaaaatacgttaccgggggggtcttgactatgagtcatccaggttcttggcattttgaacaaagaattggacaaaatgcacaaaacaacaaaagaatgaagcagtgaaagcacagacttattgaaactatgctccacagagtgggagtgggctcaaacaagttgctcaagagtgttagttacagaattttctggaatttaactactctctagaggtttcccattggttacttggttacactctatgtaaatgaagactgggcctgctaccagtctgattggttgcaggaggcaaccaatcaaaggctgaagtgaagttataaagttaaaccctatgctaatgaagacttggcccacgagcagcctgattggttgtgggaggtgaccaatcagaggtactttccattttttcatctgtgacacagtggaaggggggtgggccgcaaagggagtagctgctgttcttttgttacttggatgtggagtggtgttttccttttgattcagttctaggaagtcagcacaaatcggccttagggtccctgcctccagaccctattcttctgcctcaatagtactataatttttgcttcatctgtcaaacataatttaaaaaactcaaaaggagaaacaaatccagttacctatatttttacactttccatttttcttccttccttcctaatagtgattcaatttttactcatttcctttctgtttagagacctttcattattcattttttcttaggagagttctgctggtgacaaattctcctggtttccctagtttttcatttgagaatgtcttgatttcccaaaggatattcttggtgggtataggtgtctgggttgaccgttcttttctttcagcacctgaaaaatattatgccacttccttctggcctccatggtttctgatgagaaaccatttgaattgttttccccatataggtatggtatcatttttttctgctgcgttcaagattttttctttgtctttagttttcagaagtttggctataatgtgtttgcctggggtttgctgagcttcttaaatctgtatgtttgtgtctcttgctaaagttgagaagttttcagcattcctttttttttttttttttttttttgagatggagtttcactctgtcacccaggctagagtgcagtggcacaatctcggctcactgcaaactccgcctcccaagctcaagcgattttcctgcctcaggctgtggagtagctgggattacaagcatgcaccaccatgcctggctaacgtttgtatttttagtagagacagggtttcgccatgttggccaggctggtctcgcactcctgacctcaggtgatctgcctgcctcggcctcccgaagtgctgggattacaggtgtgagccaccacgcctggccgtatttctttaaatactgtcagctttgtcctttttcacctgtctttagtgctctgatgacatgaatatcagatcatttgttatagtcccatgggtttttgaggttcacttttctctccttatcagaatggataattctatcgttctttgttttcttactgttcactgattccttccacatccccttcattctcttgttatgcattttcattgagattttcgactttttttttagctctaaattttccctttggttctgtaatccaaaaagttatcagagacaagtctcaatcaattcagaatttcattttggcaaggttaaggacatgcccagaataaaaaaaaaacactttggagaaaggtatttggtgtgtttgtggtgtgtgttgtgtctggtgtgtgtggtgtgcatgtgtgtgtgtctggtgtgtgtgtggtgtatgtggtgtgtgtagtgtgtgtggtgtatgtggtgtgtgcctgtatctggtgcatgtggtatgtgtgtggtgtgtgtgtgtgtggtgtgtgcatgtgtgtgtggtgtgtgcacttgtgtctagtgtgtgtatgtggtgtatttgtgtctagtgtgtgtggtgtgtgtgtctgatgtgtgtggtgtgcgtgtgtttgtggtgtctctgtggtgtgtttgtgtatggtctgtgtggcatgcatgtgtatggtgtgtgtctgttgtgtgtctggtgtttggtgtgtgtatgtgtgttttgtgtgtgtggtgtatacgtgtgtggtgtgtgtgtgggtgtgaagtatgtgtgtagtgtgtgtggtgtgtgtgtggtgtgtgcatgtttgtggtggctgtgtgtccagtgtgtgtgtgtgtggtgtatctgtgcatgtgtgtggtgtgtgcgcttgtgtgtccagtgtgtgtgtatggtgtatgtgtgtctggtatgtgtggtgtgagtgtgtgtgtggtgtatgcatgtgtgtggtgtgtggtgcgtgtgtgtgtctggtgtgtgtgtttgcgtgtcctttgtgtctggtgtgtgtggtgtacgtatggtgtgcgtgtaggtgtgtagtgtgtgtgtgtttggtgttggtgtgtgtggtgtgcatgtgtgtggtgtgtgcgcttgtgtgtccagtgtgtgtgtatggtgtatgtgtgtctggtttgtgtggggtgtgtgcgtgtgtgtgtgtggtgtatgcatgtgtgtgtcgtgtgtggtgcatgtgtgtgatgtgtgtctgtgtgtgatgtgtgtctgtgtgtgtgtgtggagagggagatttatcatgaggaactggctcatgtgatcacagaggctggcatgtccacatctgtggttctgcctggcgggcttgtgtgctgtccacacatggagagctgatgatgcagttcccgatggcggtggccggcagaggtgaaatccagaggcacctgctggagacttttcccttacccaggggagggttggtcttgaatgtgggttgaatgaggtccaccccacattacagagagcagtggtcttcactctgtggattaaagtgataatctcatctcagagcacctttgtagaagtatctgtaaggtactgtcaagtgtacttgaccaagtatctgagtaccccgtggcccagctaagttgacacaacattaaccatcacagcatctaagaaattggtgctcttcttggttcttagtatgacaagtgagtttcagttgaaaactggccatttttggcctttcagcatgggaccttggatctcagttaagcattctgcgttggctgtcagggaaggaggagggctgctgtcttgttgccggtgagtgcagaagtctaggttccccacttggcatctgttgacttatggtagcgtgttctccttactgctgggcgggggtggccggtctggctccccaccatgcctcaagggaactttcctggctgggagggttagaggtgccttgttcttgttctccacgtgatttctgcacactgtgtgtgggtgggcggctttgtgactgctggatggtggtaaaagtcctggctgcacaaggcccttctgatagctccctagctgcagggggtgcccctactgcctgtgtaaatggaagtcaaggtgtcccgtgtggtcttcactagtaccgcggaggtgggcttgggctggggggccgtgataacccctgctgaggaggaacgttccacttcctacttggctttctctgacagcaccccatggagggtgaggggattcggatgcctcactgcagtctaggtgctcctctgggtctttgctggaagggagggatggagatggagccagcgttttctgtgagttgtctgagagctccctgtcctgctaggctgccttggttagggagagctggcttttgctggtactttttttggtcgtctgtgccccttgggcatttccaaattttaggcttcagcagctccaaatgtgggatataagaggcaagaagaaaaccccagaaacacaccttatatcctggggtcctagctagtctgctctattttctccatctttcagagtcattctatatttgctttatgaataattttcagtatgttaattccacctagtgggaacaatatggcagagtatgtctgctccatcttcccagaagtggaagtcctgttttttaagatgagaggaattagagccagttggctactgatgggaacactccactggggagggaaattgcgggagccaagtgcttgagcaggtgagaggggctgaggctacagcagcgatatctcctttttctcaagaagggaggacaggtttgagggtgtgcttgtgggaagttggtggctttggtggccactcagtccacagatctgagctgcatgtgagtccggacagaggtgtggtctagtggttcatattctaggaacatgaactgcagctggagctgagattctgaatgtcacttctggtttcggatccaggaatctcaggggccagcctggaatcagtgtccaagggtcaggaaccacgagcttcagtccatgcaggggtggaggctgcaaatccgccaggctggcagacactggagggcaggaatgccaacagcagcacctggagatcagcgcccgctgcagggcagtgccccaactgtcctcctgcctctgtcttggtggagtccatcccatgtcttgtgaactgcctctgaagagaggcgtccaggaacgggactaggggctgcctcccttggcacccaccaccctcctggtttctctccagcaccagacttgcagggagaaagaggttctctacaccccttagccacatcccctgggaatgcataaaaatgaaacaactatggaatcaaattgggttcaaaggagcgcacccttttgtgggctgtgctataaaaagcaaaagatctgggaaagaaggtccctctttgctttcagctattcagatcatgcctgagtgctgggcgctgtctcaggccaggcatgtggtgaaactgaaaatgcagatgggcccactgttgcctctcagctgtgggagctgctgcatgtggacttgggtctgatgtggacttgggcctgtgggcccccttcaggaggacatggctttggagctgcccaggatgtctggtagccagggaggtgtctggcagaggttgggtgctcatgccacctcggggcatccacactgctgtggctccctgggcctactgcttggcttttgagtgttgccaggcagtggctggcagcactgagtgtccctggtcctctgggagctgcagtccagagagaactctgccagcaagggcacgtctgcctgtgggtgctgcctggactccagccccatgcttggacctccctgtgactggcctccccactgcctggaccctaccaggtgtgtgcttctgagaaggaggcctgttgggggctgggggtgctcctgtggccgggactgtgttttgtccctgtccttcctcatctccctctccttgcttccagacaaacgatgcggccggcaacacctggaactggctctacttcatccctctcatcatcatcggctccttcttcatgctcaacctggtgctgggcgtgctctcggggtgagagaccatgtgggggatgtgcaggtgcccctctgtgttctcagctgaggggtcaacaggggcacgtgtgacacttggggtgggggcctggcccatgggtgccctctgtggtggttgcccctggtgttctgggttctggtagcccttcctttgtgccaccatcctgacctgtccttgatcagcctctcggccccttatccctgtcatacccctggcctttccgtggtctctgccatgggagagtagctgccactactcatctgggtagacaggaggtgtggtctgtaatgggaggttggtctggggggatgggaggtgtggtctgtaatgggaggttggtctggggggatgggaggtgtggtctgtattgggaggttggtctgggtggatgggaggtgtggtctgtgatgggaagtgtggtcttggtagatggaggtgtggtctgggacagggtttctgagcagcctctgtggccacagagagcccctctgttactgtggtgagaaataactgggggcaccctgatctctgtagcagtcaccactgggctcgccaccctggccctgactgctggtgtccacttcctctcaggtcacctctttgtgccaagctactccaggggatggtgagagagagggctcagggctgggggtccatgctggagaaggtggagaaagagtcctctctgggagtgggatgtggtaggcgggcatggccaggtgggcctgtgggcacacagcccctcctgtcccaccctggggctgagagctgaagagatgccatgtatggggcctgactgggtttggtatttggggctcctgccctaccacagggcaaggagttgtgctaggaaggaggtggaaggcatcaggcctgcctggcttcctgctcccaccttggcctcagctccccagtgaggctggaggagtacatctcccctctgtcctcactatgatccctgctcaggcccacggctccgagccaggctggggatagagcctggtgaacctgggagttctgccacgctgagcaggacaggagcagccagagtggggatggctggagccgaagcctctgggctccagcaggagatcgtgcccttggttttggccctgtcctgtaaagggtgtgattgtcattagcaggcctctccaaaagcctccatgggaaccagcaagcgaccggctcacgggatggaaatagaactcctagcctggcggggtagctggcggaggcttgaggcttggaggaggcaccgggggagggacatctcagctgagaccccactgggggactaggaatgagccaggctaaggaaggaggagggtctttcaggcagagaacagctggggtggaggcacagtggacagaaggttgtggcctgtgtgttgcagagatgcttggagctggagtcagagggtgttgtggggagagggcacaggggctgtcagggggctggcagccaccaggcttgtgaggtgcctgggctgtgctgagggtgctgcctggtgccaaaggtgctgagaacgctgcctggtgggaagcctggcaggagcataggtgggttcaaggggaggcaggagagcagcctgctcagggcttccttctgcatccctctagggaatgtgcagaatagcctgaggggctggaggggaggcccaaggcagggcctgcacggtatttcccactccttccccactgtgaggatcctggcctctggggagaatgggatatgtgatgttcctcccatcagcgcagctgaaccctccctcaggcccacaggcccagcagagggcccccaagccaggggctggcaccccccatgtgggtcctgcaccccggggtggcagtggtgagaggccgccttcccagccttgctctgtgggaaaagccgcggctctgccatgtctgggcgagagctgcaggaggggccagcttggggccaattcggcatctctctctccattcccagagctcccatcctcacagcatcccagagaagcagaagaggtggcccctgtcctgcctcttctcacccagcgaggacagaagctcagggagggctggccctgctgccggccactgcgtgagaagcagctgctctgtggagggggccagactgctggggggagttgctgctgggagctctcagatcagttcaagcagtgatgtccttgcccttcccctgccccccaggccctctcattctcagggcatggccacagggattggtctgggtggggaggccacagtggaccctgccttcctgtagatttgggacttgggatgcccagatgggagggtgcacctgggcaggcctggtcaccttgcactgcctgggctgtagcagctcagtgcctagcggacactggccctgcgcccagggtcagtcacggtcagagccggggattgttgcaccggggctgtgtgtgctgggagtcatacctgccacacccactccaccaactcagaagcttgtgtgtgtgtgtgtgtgtgtgtgagagagagagagagagagagagggggagagagagagagagagaatggcttgcttctggcactgtgagccttaaagcttggccaggaggctggggctgggctggggatgctgagctggaagggcaagtgttctctgctggtcaccatgacggctgtgaaggctcaggcggggctggggtgagatgtcgggggccaatgacagaaggtctcctctcctgctcactgtgagcctcagaggcttggttgaggaggctacgtggactctgcggtattacccttctgcctctggcctgccctgacccagtcccttcttccctgtccctgtctgtccctcccacttcccacagaggctttgcatctgaaccaacagaggaagcaaagtgaacgttctcctctggagaattctcgccaggagctctctggaggacagcagataacagagcctggcacaaggggagggaggaggcgcatgcctaggttgctgtaggcaggggctgtgaaattgtccctgctctctagaactgcccctctggggaccaaggcaccgtccctaagtgccacgggagtctgaggatggagggccacctgggctgctcatggaggccctctgggtgcccagggagctgtctggtgctctggagtgctcatctggagtgctcaggttagaagaggcctgggtggcaggggcctgcctgaagcagcagcctgcagcctgcgtctcctgtcccaggctttccctggtcctttttgtctctggggctgcacacctgtggggcttgcactcacctgatcttgcttttccggcccctgcatggtagggagtttgccaaggagcgagagagggtggagaaccgccgcgccttcctgaagctgcgccggcagcagcagatcgagcgagagctcaacgggtacctggagtggatcttcaaggcgggtgagggcccgtgggagccactgcactcctggccggccactgttagttctctgtccccaattctgctctgctgccagctggggtgccctggctgctgggtagagcctgaagggattttgtagtgagcagagtgagaagggatttctctctagctcacccaggggcctggcaccaggcagccatatggctctgaggacagtggccttttaaatggaggactctgccatggcccagcctaaagctggtctctccccattagtgtcagccaagtcccttctgtgccctgactctgggttttgtcaagcctggactccctcccctcgccccaggccagcactctttcctccacatggggcatccactcacacctcctaaggtttcccaagtgcctcttcagagatgaactcgcctgtggcacagctgttctcagggaagcgacgtgtgggtagggacgggcagacacaaggcggctgagtcctcttcacaggggactgtctgtccctgtagaaaaagctcagctgtgggccctgctggcttctggaagtctaagagctgataaggcagccaggtgcagtggctcacgcctacagtcccagcactttgggaggccgaggtgggcggatcacctgaggtcaggagttcaagactatcctggccaacatggtgaaaccccatctctactaaaaatacaaaaattagccgggcatggtagcacgtccctgtaatcccagtggggaggctgaggcaggagaatcgcttgaacccggaaggtggaggttgcagtgagccgagattgtgccactgcactccagcctgggtgacagagcgagactccatctcaaaaaaaaaaaaaaaaagagctgagaaggcagggccttccagacagagatgtgcctctgtcctggggcattcctggggtcaggagggctctgacctgaggctgtgttcccctcgcagaggaagtcatgctggccgaggaggacaggaatgcagaggagaagtcccctttggacggtaggtggcacttgctggtactcctgtgtggtggagtgctctggtggccacgtgggtggtgacacgtgcctgcttgcatgtttcacgcgaagtgctcttggcagtgccaggcacctgcacagccatcacatgaacacagactagggccatggtgtctgaccctggcacctgacacaggcccacactgcaggtttaaaccgagctgtgtctatccccagggcttggggtgctgctgctcccagagaccatgggagggctcatggcacaacctggggccatgagagggagcccgggccccactgctgtggttgctggcactagttaccagcatagctgcagcagcaggaaggctgccctctctgcacacccaccgctcaggtcagggccagacagcatgggcacttccgtggcaatctcagccggccccatgcctgcggctctgagcaggtctatgctgtccctgttgtagtcctggccttgccccagatggacgtttcctggtctccctggtggccaggcctccccactggcctcattttggaagaaagggaaagcggggacccctcaccctcaaaattccttgtcccttcagctctggggactgggagggacccaagggggcccacaatcatccggcctcagccccagttcaggacaggagctcaggagaggtcactggtcccagggggagggtgatcccatgccccgctgaggcaggtggcctgagggctgcagctcaggcagtctctcccatcctttgtttaaagcagtgctgaagagagcggccaccaagaagagcagaaatgacctgatccacgcagaggagggagaggaccggtttgcagatctctgtgctgttggtgagtctcagggtgtccctccagctctgccaggcttgagctggacatggagtgcatgctccgcttcccctgctacccagccactgttggacgccccttcttgcccaaacgcctgcaggctcctttcagacagtttgctgctcctggctttgtgacccccatgtggacatagggcccttagccatatcccaaggctggaggactctatagggccacctctctcttcagcccctgtctctttttcactttctggacctgctgcctctgaggctgttgtgtcatcccctacctctcaaatagtacaaggaacattctggttaatttatccaacagagctgtgtcggttcccttcctctctatctggtaccagattctggttccagaagtgcctgggccttgcttcattttgagacaccaagtcagatccaatctggacttccttgctgtacagcagtctgtgagtggaccagatttagaagatgtctaccattatattgttacatgtatgagacagaactctttaataaaacaggaaacacacacacactcatgcgtacacacacatacacttaaactggaccttttctgtcctcactcagcactaggaaactcctgttaacaacttccaatgtacccttccctatttctccatgctcacctcagataacacacacaaacactcatacatccacacacaaatatgcatgtagagttttggagtcttctgttacaaaaatgatttcatacaaacttttctcaccagtccctttcctaatctgctcctaatcaatttgtctgattctagccccccttgtcgggtgcaacctggcgttgctgatgtggagtcactggagttgttcagttgctcgtctgctgatcgtctgctgatggccatttatttctagtgcttttatctcactatgaaaaatactgcccccaagtctttgtgaatggctgtccttcctcactagtgcttttctctgtggggcagattcccaggagcaggtgctgagggtaagggtgtggtactgttcagagttctgtgcgaccccacattccatccacagtacaggccaaccttcgccctcatccagtgctatgtgacggctccttttgatttttcccagtttgaggccaatttgatgagtgtagagtaatatttctttggcactacaattttcctttctcctactgtccgtgatgctggccctctttctaaatgtttgttccctgtctggacttggcctttggtgactcttcccatatgctatacagttttctagtgagtttgtttgtaaattattttgtatttattttgacaataatgagataccaatgtatatcatagatctgaatgttttatcatcttataattttattttatttaattaatttttttttgagacaaaaatttcgctcttgttgcccaggctggagtgcaatggtgcaatctcggctcactgcaacctctgtctcccaggttctagtgattctcctgcctcagcaacccgagtagctgggattataggcatgcaccaactgcccagctaattttttgtatttttagaagagacagggtttcaccgtgttggcctggctgttctcgaactcctgacctcaggtgatctacccaccttggcctcccaaagggctgggattacaggtgtgagccaccacacctggtccatcttataattttaaacaatttattatatgattgtggtagctaaatagtttccttctattgctattttatctagagtttttattctgattttgtaaaatgaattgaagagttaaaatgtcttcatctatggtttggaatcctttaaataacactggaattatctttttttatagatgagataaaactgtgaatctatataatccaaaaaagaaaaaaaaaaaggatttggaccagtgttgtgacttaggctttgttaggaaatcgccccgttctcagggtgttgggatccctttctgtggcgctgtgcaccggctctctggcgattctcttaacctcgcctgtgtcgagtgcttgtgcctcattcagcagatgtctatccagtgcccgccacgtgccagcaacggaggcatgggggccgcgacactggagaaactcctaataaaggcccttcatcattggagtttccgtccagtgggggcatcaaacaacaaataagatagtaaggaaaataggccgcatgccagagcccctgtccggaggaggaagaggtcaggaaggcaggagtggaagcgtgtggagggggggcggtgccagaagttcatggccatagaaggcctgaggaaaaagactgcctttgagtaaaagagttgcaggaagtgaggacgcctgagggacgccggggcgggggagaggggaggttggcctgagggaagccaggggaggggaggtcagcctgaggaactactctcaggccgacctggagagagaggggagcttggcctgaggaacgtgtgtggcggggagggaaagttggcctgagtgagggggagggggagggaaggtcggccggagggaagccgggagaggggagttaggcctgagggacacccggagagaagggaggtccggggagaggggaggtcggtctgagggacacggggcgtggggtggcgaggtaggggagcgggaaggggaggttggcctgagggacgcggcggtggggtgtgggggaggttggcctgactgggggggagggggaggggaggtcagcctgagagacggagggggaggggaggtcggcctgaatgaaggacacccaggagaggggagatgcgagacgccgccagggaggggaggtcagcctgagggatgcccaggggagagaggggaggtcaggggagaggtgaggtcggcctgagggacctctgggaaaggacattccaggcaacgagtgccaagaccctgaggcaaggctgtgcttggcacccaggtgtggagaacgtcttggaggccagcgcggctggagtgaggtgccatgggctgtcggtagcggtcgaggaaacctgagagtcagacaggctcacttccaaccgggaccccaggccgccctggtggtttgcagaggggtgacaccctctggcttctgtggtataagggtctctctggagactgtgtaaagtgttcctttttctccacaacctctccatcatgtttgttttgttttgtttactttttaataatagtcattctgattggggtgagatgatatctcattttggttttgatttgtatttctctaataatcagtaacgttggttttttttcatgtttgttggccacacgtatgtcttcttttgagaagtgtccgttcatggcctttgcctactttttaatggggttgtttgttctctcagcaccgtttattaagtagggtattctatttaataatagggaatacatcctagctttattcctaggtattttatttttatttttttgtggcaattgcaaatgggagttcatgcataatttggctctcagcttgcctgttgttggtatataagaatgctggcgatttttgaacattgattttgtatcctgagacttagctgaagttgtttatcagcttgagaatattttgggctcagatgatggcatctgcaaacaaagatggtttgacttccctttctatgtaaataccctttatttctttatcttgccagattgctctggccagaacttccaatactatgttggataggagtggtgagagacatcttgtcttgtgcaggttttcaaggggaatgcttccagcttttgcccattcatgatgatattggctatggctttgtcatatatgtctcttattattctgaggtatgtccctttaatatctagtttattaagagtttttaacatgaagggatgttgaattttattgaaggtcttttctgcatctattgagataatcatgtggtttttgcctttagatctgtttatgtgatgaatcacatttattgatttgggtatgttgaaccaaccttgcatcccagggatgaagcctacttgattgtggtggatagattgtggtggataagctttttgatgtgctgctggatttggtttgccagtattttgttgaggatttttgcatcaatgttcatctaggatattggcctgaagttttctttttttgttgtatctgtcaggttttggtatgaggatgatgctggtctcatagaatgagttagggaggagtccttcctttacaattgtttagaatagtttcagtagaattgataccagctcatctttgtacctctgggagaattgagctgtgagtccatctggacctgggctttttttgattggtaggctatttattactgcctcaattttagacctcattattggtcttttcagggattcaatttattcctggttcaatcttaggaaggtgtatgtgtccaggaatttattcatttcttctagattttctagtttatgtgcatagaggtgtttatagtattctctgatggttgtctgtatttctgtggggtcagtggtgatatctcctttatcatttctgattgtgtttatttgaatcttctctcttctctttttttttagtctagctagtggtctatctattttattaatttttttttttttcaaaaaactagctcctgttttcattgatttttttgatggatttttcatgttttctatctccttcagttcagctctgatcttagttatttcttgttttctgctagctttggggtttgtttgctcttggttctctaattcttttagttgtgatgttaggttgttaacttgagatctttctttttggtatgggcatttagtgctataaatttccctcttaacactgctttaactgtgtcccagagattctggtatgttatatctttgttctcattagtttcaaagaactttttgatttctgcattaatttcattatttacccaaaattcattcaggagcaggttgttcattttgcatgtagttgtgtggttttgagtgaatttcttaatcttgagttctaatttgattgtaccatggtcttagagactgttattatttcagttcttttgcatttgctgaggagtgtttgacttccaattatgtgatcaattttagagtaagtgttgtgtggcgatgagaagaatgtatattacgttgtctttgggtggagagttctgtatatatctatcaggtccacttgatccagaggtgagttcaactcctgaatgtctttgttgattttcagtcttgatgatctgcctaatattgttggtaggttgttaaagtctcccattgttattgtgtgagagtctaagtctctttgaagtctccaagaacttgcttcatgaatctgggtactcctgtattgggtacatatatatttaggacacttagctcttcttgttgaattgaaccctttaccactatgtaatacccttcatcatcttttttgatctttggtgatttaacgtctgttttgtcagaaactaggattgcaacccctactcttttctgttttccatttgcttcataaattttcctccatccctttattttgagcccatgtgtgtctttgcatgtgatgtgggtcttttgaagacaacatactgatgggtattggttctttaacctgcctgccattctgcgtcttttaattggtgcatttagcctatttacatttaaagttagtattgttattattattattttttgagacagtctcactctgtcgcccaggctggagtgcagtggcgtgatctcagctcactgcaacctccgcctcccaagttcaagtgattctcctgcctcagccttccaagtatctctgggactacaggcatgtgccaccacacctggctaatttttttgtatttttagtagagatgaggtttcaccatgttggtcaggctggttgaactccagacctcaaatgatctgcctgcctcggcctcccaaggtgctgggattatagtcgtgagccaccatggcccgcctaaagttggtattgttacgtgtggatttgatcctgtcatcatgatgctagctggttattttgcagagtttttatgtagtttcttcatagtgtcactggtctgtttacttcagtttgtttttgcagcggctagtaatggtttttcctttccatatttagtgcttccattaggaccccttgtagggcaggtctggtaataacgaattccctcagcatttgcttgcctgaaaaggatcttatttctccttcacttatgaagcttgatttggccagatatgaaattctggatttggaattcttttaagaatgttgaatattggcccccaatctcttctagcttgtagggtttccactgagaggtccactgctagtctgatgggattccctttgcaggtgacctggcctttctctctggctgcccttaacattctttccttcacttcaaccttagagagtctgatgattatgtgtcttggggatgatcttctcatggagtattttactggggctctctgcatttcctgaatttgaatgttggccagtcttgctaggttgaggaagttctcctggatgatatcctgaagtacattttccaacttgttccaatctccctgtctctttaagttatcctaatcagtcatagattcagtctctttacataatcccatatttctcagaggttttgttcatttctttccactcttttttctctgtttttgtctgcctgtcttatttcagaaaaattgtcttccagctctgagattctttcctctgcttgatctgttctgctattaatacttgtgattgcattgtgaagttcttgtagtgtgtttttcagctctaacaggttggttatgttcctttctaaactggctgtattggctatcagttcctgtattgttttatcatgattgttagcttctttgcattgggttaccacatgctcttatagcctcataagtgaagttcattattacccaccttctgaagcctacttctatcatttcaacagtctcagtttcagcccagttctgagcccttgctggagaggtgttgtggtcatttggaagaaaaggggcactctggctttttgagttttaagcatttttgtgttgattatttctcatctttgtgggcttatccacctttgatctgtgaggttgctgacctttggatggggtttttgtgttttgttgttgttgttgttttctgtttgtttgctttccttttagcagtctggcctctcttccctagggctgctgcagttttctgtgggtccactccagagcctagttgccttggttttccctgtacttggtggtatcgccagtgaaggtcgtgaaacagcaaagatggcatcctgccgcatcctctataagctttgtcccagggggtgctgacctattgctggcctgaatgtgcctgtaggaggtggctggagaccccagttgggaggtcttacccagtcaggaggaatgggatcaaggacccatttaaagaagcagcctgactgctttttgatagagcagctgtgctgttttggagatgccttcgttccctgatcagtttgagctttccaagtcccacaggctggaatggctgagaagcctgaatgaccaaagtggtggcctgccctgcccctcctgtgtcctgtgtttaaaagatattggattataggtatatttattaaaatcaagtctattggccgggcgcggtggcgcatgcctgtaatcccagcagtttgagaggctgaggccagaagattgcttgaggccaggagtttgagacaagcctggacaacatagtgagatcccacctctacaaagaaattaaaaacttagctgagcatggtggtgcatgcctgtagtcctacttcattttatttatttatttatttatttatttatttatttatttatttaagacagagtctaaccctgtcgcctaggctggaatgcaatggcatgatctcggctcattgcaacctctgcctcctgggttcaaacgattctcctccctcagagggattacaggcacccaccaccacgcccagctaatttttgtgtttttagtagagacagggtttcaccaggttggccaggctggtcttgaactctgacctcatgatccgcccgccttggcctcccaaagtgtggggattacaggcgtgagccactgtgcccagctcattttattttttatgaagttcctcttgtatttctagtgacttttgtttatatatttagtcactgtatagtttgggcaatataaagtttatgattgttacatcttcttcctaaattatgctttatttcatcacacagtaccttcttaatctgtgcagttcctctgctggacagttgcaccttgtcgacattgaatgtcattggttctactttttgttgctatcactggttttggtttttaacttgcatttgcctggtacctttcttttcctttcatttccagctcttctttatcattttaagtgttcttgtaaattgtatttacctgggttctgccttttaaatttttttttttttttttgagacagagtcttgctctgttgcccaggctggagtgcagtggcgcgatcttggctcactgcaagctctgcctcccgggttcatgccattctcctgcctcagcctcctgagtagctgggactacaggcacctaccaccaggcctggctaattttttgcattttgtttagcagagactgggtttcaccgtgttagccaggatggtctcgatctcctgacctcgtgatctgcctgcctcagcctctgaaagtgctggggttacaggcgtgggccactgtgcctggccaaaattttttttattttttatttttttaatgagacggagtcttgctctgtcacccaggctggagtgcagtggtgcgatctcagctccctgcaacctctgcctcctgggttcaagccattctcctgcctcagcctcccaagtagctgggactacaggcacgtgccaccacgcccagctaattttttgtatttttagtagagaaggagtttcaccatgttagccaggacagtctcgatctcctgacctcgtgatccgcccgccttggcctcccaaagtgctgggattacaggcgtgagccaccgcacccagccaattttttaaaattttatttatgtatttaagagacagagttacgttgcccaggatgatcctcctgtctcagcctcctgagtagctgggactataggtgtgcaccaccatgcctggcttggtggttttgcttttttttttttaaaaaaaaaacccagttgtatggtgtctgtttctaatggtaacgggtgaatccagtctctccatttagtataatgtttgactctattcttcatcccaagttctgctgctttaatcgagttgctgtttattgctcctctcctcccttgcttatttttactctctaattcttctgttccacaaaaggttgccttcccttccctgctctcataattgtcaacgtacctctttactgtttttgtttctttagcatctttagtaccaagatgtactagttccatcactcaattggtctatttccctttattctgcctccacccatacccagtaagtcacagcctttccagtacttgccctgcctccgcatcctggtttgagggtgttcacttttcattcttgactgtcgcccgtcccttcagactgcccccacaggctcccctatgcccaggggccctcagctatcattcccgtggcccgctctcagagccctaacctcagtcacctaggtttaccttagcatcttctcttctcttcagtccttgctcactgcaggactgtctcctccgttttaactctgtcctgtcactcggctgctctcccctgaaatgaatgggggtgttggtggtggctgactcttcgagttcctgtgtactctcaggtgcccttccttgttccccactgaggagcgagatccaggctgctgtgcccactgcaagtgtctctctctctcatttcctgttgcacatgaggcatcggacactcggatgcttttcctttgtcagtgacttgctctctgtctgcccctcaaactgcaggctcagggcccctctggcgcggagtgcttccctccgtttgtctcattattctgtctccttttcttgatctcctgcatctggagcccctcctgtttcacgtggtgttgcttgctctgctcctgtcagtccatgccctcttccttgagctcgcgttcacctccacgttggagatgctgcttgcgcttgactgaactcccctttttttcatctgctgagtggtttccgaagagaattttatttcttctctaaaagtttttttctctctcttttagttttgttttattttgagttatgtgttgctatacttggatctctgggcctttgttgacttttccttctgggtacccagcagacaccgaggattcacttacattcaggacccactggcctccactgttggttcagggtgggcttggggcctggggcctggtggggaggagacgaagccgtgcttgaatctccacattctcagcactgcttggtgccctcgactgccttctgcctgaggactggctgtgtcaccaccccaggcttgcccataacccgtgtcaccctgtcggccctgacgccttgtcagctggttgagccccgctgagcttggccctgtgctgtctcactgaatcccacaccaccttgtgaggtacaggtgactgtgctctgttttcagttgaggaatctccaggctgcgtgatgtgcacgagggccaggggtgacagccattagggcctccatcagctcgtgctttagcctcacgtcacttttgttgcccccagtggcaaatacagcagctgcactggaaggaaacactttcttgtctgtctccccactgtcctctagaagggttattgagaacagggatggatgttggtcattttgtgttttctgggctttggtcagggcctggcacaatttgtacacattttttgaacaaatgggggttacccaggactagcaaagagtctgccttagggcacaagagaaagaaatctaagtatttgcagcagtcaggccctattctcagcagtacttcactgtgtcatcattcataggttaatgtaatatggaatttctccctagcttgaagatgtcctatcatttttcttgaaataagctttttcattataaagaatatatgctaattaagtgaaccctggaaaatgcaggaagctgaaaagaagcccagtctctcttggttttcccaaagctgtgattccagagatgtttccgcgtttcctgtagactctctgcttttactggagcagactggagtccacagtggctgcttgctgtccttagggacctgtgcctcatccccggggaacaaatgcatctgtcttgggtgctgctggggttgctgagctgggatgtgaggggctgcacccagctctcccccagggcgtctggatcaggagtccctctgttaggtcttgctcagtcccctggctctggcgcctctggcttctctaaagtcgatgtttacagcaaggaactggtggactttaagggcaatgtctggggagtgtggttctgtgcaaatacggctgttggcatgactatggttgtgcctgtgacaggcgaggatgtgtgtggttgtcttgtgttgtgtgcacaggaagatgtgtgtgtgtggggggctgtggcccattgtgaaagggcagcatttctatgaggcctttctcatagcagaggctgactggttcttactggctggtggggatggccacagagtcccctttggagaatttgttgcttgtcttcctggccacgtgtgtgtgcagacacagtgggtttacatgagtcacgtgttctctttccctccttcccagagtggccctgtttgtgtccacaggtgtgtgcctcatgtgcactgaggagtgtgtctgtgtgagcatctcattggatcttcaaaagtgagcgtggtcaggctggatgtgtgctgtgaagcatgtgcgtgtgtgactcctgtgttcctgcacaactgtgtgtgggtgcatggggggttcagagtgtgtgggcttgttctgtgcacagctctgcctgtgtgtgtgcccctccttatctgcattgcacacctgcctccctcctgccctactgctgcctctgtggggagtggtcatccctggccttcagcagggctggccacatgccactgagagcctgggtgtgcacatgtacacacatgtgtacaaacacacagaaaatgcacatagcacacgagctatgagagccactgagagcctgggtgtgcacacatatgcatgtgtgtacaaacagaaaatatgcatagcacacatgcccacactgcccctgctcttttgtgccactgagaacctgggtgtgcacacatatgcatgtgtgtacaaacacacagaaagtacatgtagcatacactgctccccacatcctcacacagggaccccatgctcaagcccaggtattcaaagcccactgagagacccatggctggggcacagctgtctgctctctgagaacactgagaggcacccacatggccaggcttagtgcacaaactaagaaacccttacacaggcagatgtgctctcctgcagagacacagccagctcctgtacagacacacctgaatcctcatagagacccttccctcagttgttaagcattgatcaagcccctctcagtgtgaggggctcagtggtgaagaagacaatgtggccctgtcctcatggagcctacagtcttgtctgggagttgggcatggaacaggtcaacaataaaacacagtgacaggtggtgatgtggtcagggccactgtcggaggtgagccgagggccctgttctaaatggtgtgcccagagcaggtgctctgtgcaggtgacgttaatgctgagacttgaaagtgtgtgggaaggagtccagtgagggacgcatttcacacttgggatattgtgtgaagggccagggcacagcaggactggtgtgcgtggacatgggaaaaggctgctgggttgggtggtgagcagggtagagaagcagtcaggctggagcaggtagacaaagtttccaacagtaagtattgtggacattgaacagccatggaccatgcgtaaaccgatgagcttggctgtgttccaggaaaactgcttagaaaacaggcagcccatgcgtgctgacccctgagtccggagggcgagagagggagggccagatgctgcagggctctgtgggctatgctgaagagatgggatctggggagggactaactcagatttatgtcttcaggggaaaaagcttggggtgctcatggagagtggcctgggggcatcagggctgtgctcctagaaggtggctggggatgctggggaccagagaagtgagtacagatcatccacttcaatctggctctcacatctggcacccagtaaccatggagatcatcagggccttggttccctcagctgtgaagtggaggtcacaggggtcactggcacaattgtctgtgaccggctggggctgggggcaggtgtcctccagagtgcgtctgtgggggtccacaggtggggtaggcgggtgcccattggtccccacatcctcagtaactccccatcccctcaggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtgtacgtatccccgtccctccctcaggtgcttcctgagcatctctgctctcagtctggaaaccctggtccatgccctggggctaccccaggtgggacgggacccacccccatgttgctcaaagtatcccacagccctagtcagcctccaggagcctctgtgggggcctggggtgtgtccagagctggagggtggcctctccagcccctgggttccagaaagcacagctggatctgctagacccctgtccctcagcatagtgtgagactggttgaggggtccgaggcacccagggcaggatatatgtgggacgaccaggggcgagtcaggccaggcagatgggtgtcctcccctgagagggcttcagacccacagacaggggacttagccccacgctcctttccaccacgtggctgctgattctgccccgggttcctgaggggggagtcctggcttcttaccctccccaggttcccctggttaccttcatttttctttacaattggctaaatctggatgcattcatgcccttccgtggagtgagctgtttgcagttctgttccacaagcctcagcacaggggccaggatgggcccctccaggcctggtctgtcacagcctcggactctctgtcccatgtggaatacagcattgctctgtggtcttacttcacaaacaggatcaaaaccaaagagtccacccatgttttatgtcctttcaggtagtgattcagccctcctgaccccaggggtcagctgcactcaccctgctgggtgtctacagcggatctggagacagggcctgtttggggctccctggagggcctcagtctccccttgagggccctgtttgcctgaagctgccgaggcacccaggaaagccttttccgactccagagaagagctatcccagctcccagttccagcctggctgtcactgtgtcctgctgtcacggtggcctcaccagggctctagccggccggctgagccctgctctgtagaccagagggcctcacctgctctgcccaggagtgtgagggttccctgagctgcaggatctgacagctccacagtgggagagatggggctgcaggtcacctggaagcatgggtgggagagtggctgtgttggggtggaactctgggctacagtttcccaaacttgacattgaaatctacgacttccgaacggggagatggtgcggaggggcagaagcaaaaggagccaagagagctccggctcaggctccctgggcggctgcaggtcgagaagcagcttgtgtacatggaactgcctgtcccagctcctgactgacacgtcctggggcccacagggtggtacctcgggactttgcttgggcctgagttcagtgtctctcttgagtcctccggctaaggttttcccacccttgggggtcaggtggggaccaaggacttcctcctgacccagtgactaggcctgttcttccccgtgagaggctgttggtgtgcagtgagtcggcaggcagtggggtaggggtagggctgcacagcccagtcgcgcatctgctgtgtgcgagcacagggctggcagtgtccaggcgttggtgaggccacaggcatccctgaccgtagaccgctactgtgtcttctctgtggtttcctggagttcctggcttcattgtgtcactgagggaaaaatggctggagggaaatgtgggcagtgtccctgacagccgggctgggcctgagggaggcttgctcagtaggtaggacaggcttgccagaggcgagggggtgtggccgcccagcctagagcagctttgcaggggctcatcgtgggttctgtgcacctcggctgtccattctccaaggacctgccctcaatgcattgccagaaccttcaaaattgaggctcgagtggttaagaggggcactgtcaggacttgccatcctgtgagcccctggggggccttatgcagctcaccagacttgctcaccctccctctgctcccatagcacaccatcctcttggaagacaaaacctggttttagtgatctgtctctgtttccccctcagcttgtgaactcctggggagaagggtgaactctgtccccatgctggctcaaaacagcaccagtgcctgctggtaggatgcatgatacaagagtgtacgaatgaatgccctttctgggcctcagagtggaggctgagtatgtgaggctgagggcctctgttcctagggagagtgagagggcagacaggatgttggaggatttcagatctctttctctgaaagttttaccgtttgcatttcttgtacttgttccttgcaaagtgctctcactttggtctcctggggagcaaggtgtgtgcctgggtagcctcccctcccagatctagggtgtgggtgccagcagtcccatctctggggcctctcctccctgggtccgagcccctcgtgtggggagcccgaggcctttgtgacccacgcagaggggctctgggactttgtggccaggcgtgttgggcctttccaagctgcttgtgtattcccctgggcttgctggggtgctctgcactggactgcaggggtcacggctttcctgccacatctcacacctggtggtctgcacagccaggcccaggtcagagctgtagggtccagtggtctcagttgagggtggatccttccattcccgagcagccctgcctgagggtcgctgggcatccatgcctctcacagggggctctcggcttctccagggacactgcttggccttgttatcatcccatgcttagcttgagtgcctggtgattttctggctggtgtcagaggccaggcttgctacaggtgacttgctccaaggaactggttgtccatgtcctcaggccatacaaagtggggtgtccgctccctgagactcctgtctgtttgtacggtgcctgagtggtctgtgaagttgtcatctctgcttatcccaggtctgggctgctgcagacttgcccccgaccgaggctgtctggacctgtgcagcacagcccttggtggaggagattttaggagcataggggtgggaagagtgtgtggccccctcttccagtgtctgctttatcagaagttgtgtctgctgaaggtcccgtgtcccaacagagactgtagagggggattcagaagccctgggaaggccgagctggactctgcccagttgtggactctcaggggcctgcccttcatgccctcccagggccttgttctccatgtgggctctgccctgggctctgttgcctccctagcccctgctgacctggcagagccatggtgcctttggcctgaccagcactgtgagaagtttaagagccaatccctgcccaaccctttgggaggagagtcagagacagtggcctcaccctgacgcctaggactcctggctcagccagcggctgggcctcgctgggcctcctgctgcctgtggcctcacccagctctggagccacggcgttcttctgtgctgcttccctctttctgcttgggctgggtgagcaagagtctgtgtaccttgaattcccagcacagccctctagccccagcatggcctccctcagtactgaggcccggaagggtcagcaggacttctgagcccaagacagcccccctccactgctgctgtgcccgcaggaacctctgtgtgacttggtgacagtgcaaggggacagtgcctcttggcagcctcgtgctggagaggagtgcagtggtggaggaggtctaccctcggggcagcaaacgtgaacagaatacaagtcagccacagtgccgtggacattgtggggagaggcgtctttccactgggaagtcccagtggaaaggtgggagattctgacaaggaggttgagggaccccaccttcggtcagagattggggtgaggccagaggcggaaggaccagctggaagctgtagctgggcctctccttggggtaaatggggccctttgcctcatagccccaggacctcctctggtgaggagggggcacccccatgaccccagaactcacacctgggctgatctcgggagcttgcctcctgctgagcccgtccttctctgggtctcagaggcactagggactcaccacctttcagactggaacaggtacctctccgtgtccctctgaatccatcgttcctttcctaggctgagacttcagagcataggaccataggccaggcctggaaggctcagccctgggaaggcccagaggtctggtgtcctccagtctgggctggagccagagtgggaggaggcctcgagctaatccccctcttctccggcttctcctagattttgcagagtttgttttcctgggtctcttcctcacagagatgtccctgaagatgtatggcctggggcccagaagctacttccggtcctccttcaactgcttcgactttggggtgagtgagaggcctgatcaggggcccaggctgtatcctttcctgcaggtgcacacagccccctcccataggccatgcccagtgtgggctggggtctgtgaccctacatgggtcagaaaggctgcctgaagacagtgaggagcagggggctggcagcgggaggcctgtcctggcggggcctgactgatgggagtgtcagcctcagcagctctctgtcggcgggaggtcacccttccctcttctgatcctgtccatagattttcataatcagctgaaggctctgcagctacctccatgcctgggatctcgcaaacctgtggagggctcagtctctccccagtggagctcaggggggctctggccctgggcaggcttgggtacatccaccagcacttctggggttggggcacgataggccatgatggtcctgccctctctgtgaggctgggggaggtggtggccctggcctgagtctctttaccaacttatgtaggtagggaggccttggaggcagtgtgtttcccagcttaccatgacagttgaacacagacggcagggcagggcagtctgagaattaccaacttatgtaggtggggaggccttggaggcagtgtgtttcccagcttaccatgacagctgagcacagagggcagggcagggcagtctgagaattaccaacttatgtaggtaggggaagccttggaggcagtgtgtttcccagcttaccatgacagctgagcacagagggcagggcagggcagtctgagaattaccaacttatgtaggtagggaagccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtagggaggccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtggggaggccttggaggcagtgtgtttcccagcttaccatgacagctgagcacagagggcagtgctgggcagtctgagaattaccaacttatgtaggtagggaggccttggaggcagtgtgtttcccagcttaccatgacagctgagcacagagggcagggcagggcagtctgagaattaccaacttatgtaggtggggaggccttggaggcagtgtgtttcccagcttaccatgacagctgagcacagagggcagggcagggcagtctgagaattaccaacttatgtaggtagggaggccttggaggcagtgtgtttcacagcttaccatgacagctgagcacagagggcagggcagggcagtctgagaatcttctggattctcagaccccgcagggagcacaggacacttcctgggacctgaacccagagcctagggatatggcactgtcggcacctgcccagaggctgagttctgagtcttcctgctggaggctgggaatgatgggtgggcacgccgccccctgagggaggagggaggagtgggagtaagtactccctccaagtctttgtaccagagcacttcaagccctcccgtaaggagcaacaagtgggagtgacaaggagtgatgagtgggagcattgcccctctcagggtggagtgaagggtgggagcagagtcccccaggaaggagtaacaggcgggtgcactacccccgcaggaaggagtgacaggtgggagcactaccccccccaggaaggagtgaagggtgggagtactaccctccctcccaggaaggagtgacaggtgggagcactgcccccccaggaaggagtgaagggtgggagcactaccctcccccccaggaaggagtgacaggtgggagcactgccctcccccaggaaggagtgatgggagcactgccccctccccaggaaggagtgaagggtgggagcactacttcccccccaggaaggagtgacaggtgggagcattgcccccccccaggaaagagcaacgggatcactactcccccaggaaggagtgaagggtgggagcactaccctcccccccaggaaggagtgacaggtgggagcactgcccccccaggaaggagtgatgggagcacttccccccccaggagggagtgaagggtgggagcaccacccctcccatgaaggagtgaagggtgggagtactaccctgccccccccaggaaggagtgacaggtgggagcactgcccccccgagaaaggagtgaagggtgggagcactaccccttccatgaaggagtgccctcccatgaaggagtgacaggtgggagcactgcctcctcaggaaggagtggggagtaggagtgccgccccccaagggagggtttggagctcggcagagtttacaggagccagagaggggcctggaccgtggtagtaaagcttcagttagaaaattcagcttaattggactttttctctcatgagcattgtacttacacaggtggtagacatttgtgtctgtgattttgttgaatcctcacaaggactctcattttactgatgataacggcagacattgtgtgactggccccaggctgcccatcagtttgagaggagtcagtgggtgagcctggctttctggcctcgggggtagtggttttgcatcatgctgtgcttctgatctctgaggaagggaaggcagtggccatccagggtgctctctgagacatggagacctgtgatttcagtagacagtgggaagacagcaacccttcttaccctttgacttcttggtcacaaagaaggtctgagtgcatcggccaagggagccgaagagatggaggcgtcagagatgcagggatctttttcatgtcttccaatcttctgatctgaactgactggatctcaggacatggggataatttgcacataagctaacacattcttctaacacttagcagctttaaactacaaaaatctgtctcacatttctatggcttaggaattcaggtgtggcactgggtatctctggcgcagggtcccccatgaggcttcagcccagttgaaggccaaggatatggtcattccacggcttgactggcactggagaatctggtgtcaagctcatgcatttggttgctggaacgccgagttcctggtcatgtggcctctccacaggctgccggagtgtcctcagctgtggtctgagggagagaactgagagtatgtacataagacagaagttatagaaaccctgtcttgaaagaaagatcccatcagttttgccatagtcttttagttaggagtgagtcactgggcccagtgactgggccggggagaggaatatatgggggcaggtattatgcaaggatgtgaacaccagacagtgatgaccactggggccatcgaagaggctgcttgccacagcctgccctctggctctcagtaactcatatccttcccattgtaaaacaccttcaccctgccaactccccaaaatcttatccattacagtatcagctcaaaatccagaatctcatcctcagttaggtccaggtgtgggtgagactccttcggtgtagttccctaagtgcagtggctgcggtacctcttaatctgttgacctgtggaactagagagttatctacactcaacattcagtgtgcagtggtaggatgggcatagggtaactgcagtagatattcctgctcagcaaggggacaccaggaagctgagccactggtccatagggattctgaaatccagctgggcacatgcgggaaagtctgggattcattgttacagacaggaagccctctgggctcttggttctgccctctcactccctttgcttttccatgaaaggtagttcaggttttcagctgaatggttttctcagcctacttcccactggcagaattttgggaatctaaagacctattttcgttttgtattgtcttgattctttcagtccaagttggtgatgtctctgcatatatgtcctctaagaactttatggatatgttgtgaagcttggggttcactttattattagaaaaaagctctacccacacctattaggccttagaccttttctgtctgtgttcctgttgaaatgctaagggtcaacacctccagtgtcttagagaagttcctgcttcattgaccagatgtgtgaggcaccctcaatctctttgaagagcctgaaagtgtggctgagtagtgctctgaggcaccacctttgatcgttttgggatctcaaataaaagtcacagtcttgcccttggcttcatctttagaccatgccacctttctctctttttaaaatttcaagttttatttagattcaggggttacacgtgcaggtttgttacatgggtatattgtgtgatgctgaggtttgggatacacacgatcctatcacccaagtagtgagcatagtacccggaagatagtttgtcaaccccttccccctccctcctccctctagtactccccactgtctattgttcccttctttgtgtccatgtgtatccttgtttagctcccacttgtgagaacgtgtggtatttggtgtttgtttctgcattaattcacttaggataatggcctctggccacatccatattactgcaaaatacatgttattttttttaatagctgtgcagtcttccatggtgtatatataatgcattttcttgatccaatccactgttaactggcacctaagttgatttgtgtccctgctgttgtgaatagtgctgtggtgaacaaatgcatgtgtctttttggtagaacgagttatagtcccttgggtatatagccagtagtgggattgctggatcaaatggtagttctattttagttctttgagaaatctgcaaactgttttccacagtgactggactaatttacattcccaccaacatccccttttctccgtagcttcgccaacatctgttattttttgactttttaataatagccattctgactggcgtgagatgatatctcactgtggttttgatttgcacgtctctgattagtggtgttgagcatttttttccatatctttgctgagaccttgccattatttatgttgagatctggagaggctaaacatattcaaaaccagcaagtcctggcttccttttatttaatgcagtttccttggtttatctctctcctctcatatttgactacaagcagcaagaagacatcaggtggcaccttcagcacttggctcagagatctcttgaggttgatcccctggttgattaagcatgttttctacctttttttgtgtgtgtgtgtctcgctctgttgcccaggttggggtgcagtggcacgatctcggctcactgcaacctctgcctcccgggttcaagcaattttcctgcctcagcctcctgagtagctgagattacaggcacccaccaacacgtccagctaatttttttgtatttttagtagagatggggtttcaccatgttggtcgggctggtcccgaactcctgacctcaagtgatctgcctgcctcagcctcccaaagtgttgggattacaggcatgagccaccacgccttgcctgttttctactttttacatagctgcatgcaacagtgtggctaaattttctgccagcacacaacaggaccccttcctctagtttcctatgaaattctcctcgctttcctgcagaccctgatgtgcagcatgcttaatgtccaaaattctatgaactgtgtgttaagtgcgctttagcccttcattaatgtgctgctcagtgtccatcctctggttccaaaaccactcccacattttaggtttttatcacaacatcaccccacttctgattccaaaatctgtattgacttttcctgctggggaacaaattatccaaaagcttggtggcataagaaaaatgtttattatttcactgtttctgtgagtcaggaatcagggtggcttaactgggtgcacctggcttgcagtctctagtgaggctgcagtcttctcaggctcatttggggctggagaattcacttccagcctcatgctcattatggctgtcaatggacctcaaaacatctgcttccaggctcactggtgtggctgctggcaggcctctgttcctggtcacatgggcctctcccagctgccggagtgtccttatgacatgatatttggtgttcagagaaagagttaagagttcccaagacagaaaccagtccttttgtaatctgatctcagaggtgacatcccatcacttttgctgtattctgtttactaagagtgagtcactaggtccaacccatccttaaggggatagcattatacaagggagtgaatactgggtggtagggattactgaggccatcttagaggctgcctactacatgaaccagtgaggacaaattttgataattagtggaaaacaggacagatgctggaagactggcaatgagaagaaagtatatttagaaaactacaatcttcaaccctaggcaaacatctggatgatttgctagtgcagagaaaagttggtggtgatgatcaagggcaacatgtgatcaccaagaacagatggcactcttggcaagactggggtggcaagcttacccaatttgttgtattgatagggttatcacaggttctgtgcatattggtgtacctggttgttgacagaacgttagatattctctgaatggcgatctgtggacaacgtagagaaatgtgcagcagatgactgtgcatttgagttgatccataaatggtgcacagccattcccagacatgctggttaacagattagtgtcaatctgtagggaagtctctagagatgtaccacagggctctgtcttagcatattcatcgttctctcagtgacttcgtaagagcattgacgttaagctcatcagctttgcagttgatgcgaaattggtggaaatgactgaaactttggaaaatatatgtcccaaatacaatgtaattgagtttgagaggctcaacatttgaattctccacaccagttgcagaagtgtggcttagaggaaatgagaattacacacatgaagaagacatgggcgctcctgctgactgtgagcccagattgtgccccttgaggtatggtggcctgggagagaattcagtttggggccccttgcttgtcctgtccagagggaaggtggtaaagggtctgctgtgttccagccccactggtctgtcctttctgagtccctcacaccgggccctgaccaggacggccctcctcacagtctatctgaggaatggctggaaggagggacgtgtaccttgctcacaaattccagctcaccaacatcaacagtgcatgaaacaaacaggcaggcttgccataatctgttcttggtggcatgtgctgtttcctggtcattgggagaagaaaagactcaagatgcaatttatgaatctgagtatcttggagcagtggcagaaccagggaggggaagttacagggagacagattttgctagtctgtgagagaacagtctaacagtcagggctgtctgaaagtttgcccagctccagaggtgttgaagaagacaccagtgtcaccaggctgtggtcaagcacagaggaggtattagaccaggtggttgtaaggtctgccaggaagccagcaggcctaacctggtccatgtcctgtgtcctcctggtgtgtctggggtggggggtgggagggagggcaggtaccaggactggtgggactctatagcctttcccaaaggttccaagagctcagtgtgaggtgtgtgccttgtgttaccatatctggcttgattgtcagacaaggaagcaggatggttccttacggagaggtgcagccacgcagggtgtgcacacacatccatctgcatgcacaggtgcagatacggtgcacccaaggctaatgccatcccgttgcaggtcatcgtggggagcgtctttgaagtggtctgggcggccatcaagccgggaagctcctttgggatcagtgtgctgcgggccctccgcctgctgaggatcttcaaagtcacgaagtacgtcccctgcgctcccaggcgagggcaggtgtagggtggagagggcgtgggatcagccacacagggtgcttgtccccaggagttcacagcacccagaagctctctctgtggcttatagttgatttaaatacaaaaggtggttccaaaacggccttgtggggccacatctgccctcagggccatccctgactggcctccgtgctgccggcacaccctttagctttcttgttcacttgctttccacgatttcccatcgtctcctgtcttgaaaccaccaccccatcttcccagccttcaaaggtgactttgctttgtagttaatgaggaagacagaagtcatcagatggaagcttttccatcatccagcccccaagtctgcctacctcccctgcagctccacccctggagagcctgtgtgcaccctgccatggtcctgagcttctcactgagccagcctggcacctgcctggcccctgtgctcaggcctgctttctccaccctgcaccttgctgacgatggcagtgacaagaccatgtttacagttatgtcccacttgactctggaagtgagttgctgcagtttgcctacaaagagactgaagcccaggaagtgacagatgcaggtagtgagagaaggaccagggtgaaaacccttcccctcactgccagagttgtagtggggaagagagagagagactctcctcacagcagtctcatcggcagcaaaggctgcaccgcggaggctcctgagcatctggaccctaccagacacacacgtgggccagcatggactttggtgtgtgtccttggcagctgcagggcccaacaagcagaactgccgacactgagcccgtgcagtgccaggtcataggtcacacctctagtgaccaagatgacctctcagaagcccactgacctccccagggcaactgaaatcccaggtcttttccaatccattttaaatccaaacctaagaccataggaggatatgaagctataaaggcagaagagttttgggcagagttgagtcccgctgggtccatgaatcctcactggcgctctgtgctgtgtgtcctcagacttctgttgccttcccagaacttgctggtgtgaggcttcaggaagtgtccacagggctgcctttaccccacctccaggtctggcatcttaggctccattttctcccaggaagtaggtgaccctgtcctgaggcaggctggcctagacccctgctagtcccaggagaaggttcaattcctttcccagagtcttccatcccgtctgccattagccctcaggtactttgtaagagaatccatggaggatagcggggcctctgatgtgggcgccagggagaaggacatggtttgggagcccaggggtgcccagggatagagtgagcacagaaggagaccagtgtctgtcttgcagtccctccattccagggagatgggacagcacgtgcagaggcacagggacatgagggaccggcccctcagttgccatcagcagcctcggtggcacctgtgtgccatggggacccgtgcatgagcagggcacggtcactgccctctgggatgggaagcgttgagggataccacagagagtctgcgtggtgtcaccctacaagctctccacgccgcgtgtcccttgtccctggtgagggggcactggagccagggtctctgccaccggccacagcgcttgcagatctgctgtaggttccggtgtagctcttcctgctgtgggctgatgacaacagttgtgggacttgcttcacatggcactggtctgagacacttggtggctgactgggtgttgaggagtgaggggcagggaggggccgaggatgaagtttgggattgggcctggccacctggatggtggcctcgtcctcctgaacctagggacagggagcagtttgggaggacgaagtgagtcctccactgggtgtgtttttctctgccttcccatggggccctcagggagagaagtccagggtagtgggcctgaaactccagagaaaagctctaacttcacacctaggtgtgcagccctcagggtttagaaagtcagtggagccttaagtgtggctgcagagagccatgaatgtgaagtcagcgtctggagctggctcagaccccctgcctggccccgcaggtactggagctccctgcggaacctggtggtgtccctgctgaactccatgaagtccatcatcagcctgctcttcttgctcttcctgttcattgtggtcttcgccctgctggggatgcagctgtttgggggacagtaagtgggcccgggagggagagctcaaggctgggggcttgcagggaagcagagctcagagcagacggtgccgcccaggctgcctccacccaccttcccaccaggaaggtcctcagaggggccagtgtgcagccatctgcagcctgaagcgagcaggttgaggccacgctggagcctgcaggcgctgcctcgctgctgacgggactgccacttcccaagccttcctgttttcctcaggttcaacttccaggatgagactcccacaaccaacttcgacaccttccctgccgccatcctcactgtcttccaggtaaggcacctgctctgcacatttgcggcctgcccggctcccgtctcccctgggtgctgggaaggcggactctcctgtcattccctcccttgttcctccacacggcccagatcactgacttttcagacacagtgttcctcaaacgagggaagcacaggcagtcagcaacctgcagatctccaggtccgggggccccagcccctacggtgaaggaagctggattctgtggcagcactgtagggagcaagtgtagttcccggggggcccagctggccttcaagccaccagtgtatctcttagctcctgagacttgcatgcacttctgttttttattctccgagaacaaaaacaaagcacttcctaaacttctccccctcctatctcagatcccagtgaccccctcagttctcatctgtatctggaaaactacccccctcagctcctcgggaagtgggggctgggggcccacttctctacgacggagaccttgttggctcatgcagactctgccctcttggagggttccctttcgaggactttcttggttgggtactctccccttccataggctgtggccccacagtcctgcccatgactggccttactgatgagagcatgccttgcattcctgtcccatgaaacatacttggatgccatgtctgagactgaacaggatggtggctgttgtcttgcctgtgatgcctcttacggaggcccaacaggctgtgtttgctgcaggccaggggcttggcttggctccctggctcctggggctgctgatcctacccttggtcagggctggagcctacaacttgtgtgaagagaggggccctttcggtcccactctctcgaagggaggaagtcttaccagcagacccttcagaccaaattagacgattggctcaaagaggagttctgtcctaatttgcaccacagtcctccatgactgtcccctttctcacatcttcccactcacccccaccctgctgggctggagcctatgacccgtcagctcctagtcactgccaggcagagccagctcttctcccagaggtgcatctgccccaggcctgtcagggccttgctgttgtcatcccttcttcctctctggtctcatgtttgagttgctgcctcttctcctctcctcttattcctcgagtgggaggcacttgtcagcctccgactgtcctccctttctctgacttgaaagcctcggctgctcacaggccagtgacttccagactttggtctcccagatgtttttgagctcttagtgggtgacaggacctatgtcagcctctgggacagaggtgggtggtctcccagccacacgacggggaggtcacaggcctggagctgcccgtagggtcctgaatgtcaggcaagggaaactgggaggaggcattcccagcaaagcagcaaaaacgtgaggagtgtctggggtggcgacaaggtggcaggtgtgggatgggaaactccaggtgtgggcgggccaggctgaggctttgccctgtagaagctgttgcagggaggggctccatgccaggggggtggcatggtccatgaccacagccacgctttgccatgtgtgttgcaagaaaagacctgagtgtgatgagggagagaagttgaagttgggaggaaagtgggcttttctgatcagatgatgctctgattcagacattacatgccccctgctctgaacacagcaataagataaaaaaaatacacttagaaaataaaaggacctagacaagtaaaaacaaaatctctgaggaatagaaatggaacagaacatacagtggtgagagacagcagagacccaggcaccaggacatggcttgagataggcagatgggcttgggagtctgagttccatggcagcagaagtgtgcaggtgtggctcagccccctctgagcactgggggaggtacctgggccctttggaggaggctgaggaggggtgaaggcttgttgagctgcagagaccaggaaggctgcagggcagggctgactggtggctaggtctgtaattcccacaggtgaatctggaccagggtcctgagatcccagggtgggagcccctgcttctgaatggggttgggagtggggcagggagggcatgtgaggaggaagaaagcagcttcagctgtgctcatggtggagctgcaaactgagggctgggaacagccagcatcccagacagtgccaacagcatctacagtcagaaggcgtaatcactcccaaagaaaaggaaataacagaacaaacacaggtgactttaaaccgaatatgcctaacatcctccaaggggtaaagggggaaccagttaaaaacacaaaattatgaaaaaaggcacctaagaacaaagaaaagacctaaaccaaatcctagaaatgaaatatacagctatttacattttagaagcagagtgaaccgtacgccgggtgtgatcagagagagtatgggtgagccggaggatgtggtggggctgagccagctgggcatggaggcttcctggagagaaggaagtgagggtgggctggagtggaggctcccatgtgaggtgcgaaagagagggtggccagtgccccttccgagtgagtcctggagaacatgtgctcagatgatcaagcaggataaacaaataattccagacctagacaaattgtgatctcaagaaaatcttatacgctgccctagaaaaatagatttcctacaaaataatgacagatagtctgatggccaacgtcttaggagcacagatgccagagggtcatggagaagtaacggaaacactggggtacaatcactattcgccaagaattctgaatccagacagctgtggtttaagcgtgagggcagagctaaagacactttcagacacaaataggagtgagttaccaccacccacccagatcatttgaaagcacgacaaaagcttatacatttagtaaagtggatgatttagaataaaaaatactaatgtatttttacccaagaagaaattaactgaagaaaaaacaggaaatggaaccatttcagaaattgaataattaggtcagaatcggattaagatggcagataggaggaaggactagcttgcagctcctgctcggacagacagaacagcgtctggagactcacatcatgaacttttgctccaagaactaccacgggaagttcttggaactaccacaggcaagttctcagccctgggcactggctgcctggaaatagactcagtgctgttgggggtgggcacggtaggagtgagaccagccttttggactgcgggctgcgtgggagtggggtgaggcctgtgactgctggctttctcccactttcctggaggacctgtatgactaatggccttaatcctcctgggaacataactccattggactgagaaccacacacccatcccccacagcagccacagcaagccccgcccaagcagagtctgagctcagacaccctattcctgcccccacctggtggtctttctctacccaccctgatggccgaagacaaaggttataatctcctgggggctctgtggtcctgcccaccccctgagaaacctgaatacttaattaggctaccttagggcaagtttgcatcctctctacaggacctcagctgatgctctcttgaaagcgccacctcctggctggaggccaaccaatataaaaccagcacacttaacaaaaatacagccgaggaccctcacagagtccacttcactcccctgctacccccaccagagcaggtgctggaggtcaaccaatataaaaccagcacactcaacaaaaatacagccaaggaccctcacagagtccatttcactcccctgctacccccaccagagcaggtgctggtatccgcacctgaaagacctgaagatggatcacatcacaggactcttgacagacactccccagtaccagcctgaagcctggtagctccactgggtgggtagacctgcaagagcaaaaacagtcattgcagtttggctctcaggaagccccattcctcagggcagggggagaacaccacatcaagggagcacccccaagataagagaacagcagcccttgagtcgcagatcttccctctggttccaaatgagaaggaaccaggaaaacaattctggtaatatgacaaaacaaggttcttaaacacccccagaagatcacatcagcttaccagcaatggatccaaaccaagaggaaatctctgaattgccagaaaaagaattctgaaggtcaattattaagctaatcaaggaggtaccagagaaaggtgaaattcaacttaaagaaataaaaaacatgatacaggttatgaaaggaaaattcttcagtgaaatcgcataaaaaaatcacagtttctggaaatcagggacacacttagaggaatgcaaaatgcactggaaagtctcagcaatagaatcgaacaagctgaagaaagaacttcagagctcaaagaaaaagcttttgaattaaccctatccatcagagacagaagaatttcaaaaaatgaagcctccaagaagtatgggactaagttaagtgtccaaacctaagaataattggtgttcctgaggaagaagagaaatctaaaagttaggaaaacatatttgagggaataattgaggaaaacttacctagccttgctagagatctagacatccaaatacaagaactcaaaaaacacacttgggaaattcattgcaaaattcattgcagaagaattcatcacctaggcacatagtcatcagattatctgaagtcaagatgaaggaaaaatcttaagagctatgaggcaaaaatatcaggtaacctataaaggaaaacctatcagattaacagaagatttctcaacagaaaccctacaagccagaagagattgattagggtcctatctttagtctccttaaacaaaacaattatcagccaagaattttgtgtccagtgaaactaagcctcataaatgaaggaatgatacagtcttttacaggcaaacaaatgctgagagaattcgccactaccaagccagcactataagaactgctaaaaggagctctaagtcttgaaaaaaatcttcgaaatacaccaaaatagaacctccttaagacacaaatccaacagaacctctataacaataacaatgaaaaaaacagcatggtattcaggcaacaaatagcacaatgaataggatagtatctcacatctcaatattaatgttgaatgtaaatgacctaaatgctccacttaaaagatagagaatggcagaatggataagaattcaccaaccatgtttctgctgtcttcgggagactcacctaacacataaggacttacataaacttaaaggggtggaaaaatatttcatgtgcaaatggagactaaaagcgagcaggaatagccattcttttatcagacaaaacagactttagagcaacagcacttaaaaaagacaaagagggacattatataatgataaaaagccttgtccaacaggaaaatatcataatcctaaatgtatatgcacctaacactgaagctctgaaatttataaaacaattactactagacctaagaaatgatatagacggcaacacagtaatagcgggggactttgatactccactgacagcactagacaggtcctcaagacagaaagtcaacaaagaaggaatgaacttaaactataccctacaacaaatggacttaacaggtatttacagagcattctacccaacaactgcagaatatacattctattcatcagcacatggaacattctctaagatggaccatatgataggccacaaaacaagtctcgggaaatttaaaaaaatctaaatttggagcttgcagtgagccgagatccggccactgcactccagcctgggcgacagagcgagactccgtctcaaaaaaaaaaaaaaaaaatctatattatatcaagtactctctcagacgatagtggaataaaattggaaatcaactccaaaggcacccacaaaaccaggcaaatacagggaaattaagcaacctgctcctgaatgatttttgggttaacaatgaaatcaagatgcaaatttaaaaaaatctttgaactgaacgataatagtgacacaacctatcaaaacctctgggatacagcaaaggcagtgctaagaggaaagttcatagccttaaatgcctacatcagaaagactgaaagagcacaaatagacaatctaaagtcccatctcacacaactgaagaaacaagaacaatccaaacccaaacccaccagaagaagagaagtaatgaaaatcagagcggaactaaatgaaattgaaacaaaaaaaattacaaaagataaattgaacaaaaagctggttctttttagataaataaaaagataaatttttttagttaaaatttttattttatctatctagatagataaaatttaaatttttgtctatctagattaaatttttgtctagatagattaaatttttattttgtctgtctagatggataaaatttttattttgtctatctagatagataaaattgatagaccattggtgagattaaccaataaaataagggagaagatccaaatataagctcaattagaaatgaaatgggagatattactactggtaccacagaaatacaaaagattattcgaagctactatgaacacctttatttatgcacataaactagaaaacctagaggagatggataaattcctgaaaaggtacaaccatcctagcttaaatcagggagaattagataccctgaacagaccagtaacgagtagcgagattgaaatggtaataaaaaaattacgaacaaaataaagtccaggaccagatgaattcagagcaaaattctatcagacattcaaagaagaattggtaccaatcctatcgacactattccacaaggtagagaaagagggaattctccctaaatcattctataagccaatatcaccctaataccaaaaccagggaaggacataaccaagaaagaaaactacagaccaatatccctgatgaacatagatgcagaaatcctcaacaaaatactagctaactgaatccaacagcaaattaaaaagataatccaccgtgatcaagtgggtttcatatcagggatgcagggatggtttaacatatgcaagtcaataaatgtgataacaccacataaacagaattaaaaaccaaaatcacacaatcatctcaatagatgcagaaaaagcattcaacagaatccagcatcattttatgattaagtcctcagcaaaatcagcatacacgagacataccttaatgtaataaaagccacctgtgacaaacccacagccaacataatactgaaccagtaaaagtttgaaagtattctcccaagaactggaataagacaaggatgcccactgtcaccactctcttcagcaaagtactggaagtcctaaccagagcaatcagacaagagaaagaaagaaagggcatccaaatcggtaaagaggaagtcaaactgtcactgtttgtttgccgatgatatgattatttatgttgaaaaccccaaagacttttccaaaaagctcctagaactgataaaagaattcagcaaggtttcaagatacaaaattaatgtacacaaatcagtagctcttttgctcttttatacattaacagcgatcaagctgagaatcaaataaagaactcaaccccttttacagtagctgcacaaaataaaataaatacttaggaatatacctaaccaaggaggtgaaagagctctacaagggaaacgacaaaacactgctgaaagaaatcatagacgacacaaacaaatggaaacacatcccatgttcatgtatgggtagaatcaatattgtgaaaatgactatactgccaaaagcaatctacaaattcaatgcaattcccatcaaaataccactatcattcttcacagaactagaaaaaacaatcctaaaattcagatggaaccaacaaagagcctgcatagccaaagcaagactaagcaaaaaaggccaggtgcagtggctcttgcctgtaatcccagcactttggaaggccaaggcgggcagattacctgaggtcaggagtttgagaccagcctgaccaacatgatgaaaccccaaccctacttaaaaaagtacacaaattagccaggtgcggtggcttgtgcctgtaatcccagctacttggaaggctgaggcagaagaatcacttaaactcaggaggtgaaagttgcagtgaaccaagatcgcgccatccattgcactccagtctgggtgacaagagtgagactccgtctcaaaaaaaaaaaaaaaacaaaatcagcaaaaagaacaaagctggaggcatcacattacccaacttcaaactacgatataaggtcatagtcaccaaaacaccatggtactggtataaaaataggtacatagaccaatggaaaagaatagagaacccagaaatcaacccaaatacttacagccaactgatctttgacaaaataaacaaaaacataaagtggggaaaggacaccctattcaacaaatggtgctgggataattggcaagccacaggtaggagaatgaaactggatcctcatctctcaccttatacaaaaatcaactcaagatggtcaaagacttaacctaagagctgaaaccataacaattataaagataacatcagaaaaaatccttctagacattggctaggcaaagacttcttgaccaagaacccaaaagcaaatgcaacaaaaacaaagataaatatatgagacttaattaaactacaaagcttctgcacagcaaaagaaataatcaataaacagacatcccacaaagtgggagaaaattttcacaatcaatacatctgacaaaggactaatatccagaatctgcaaagaactcaaatcagcaagaaaaaaacaaacaatctcattaaaaagagggctaaggacatgaatagacagttctcgaaagaagatatacaaaagcatatggaaaaatgcttaacatcactgtcaggggaatgcaaataaaaaccacagtgtgataccacctcactcctgcaagaatgcccataataaatgaaaaataatagatgttggtgtggatgtggtgaaaagggaacacttttacactgttagtgagaatgtgaattaatacaaccactatggaaaacattgtggagtttccttaaagaactaaaagtatatctaccaccatttgatcagcaatcccacttctagatatctactcagaggaaaagaagtcattatatgaaaaaggatacttgcacatgcatgtttatagcagcacaatttggaattgcaaaaatatggaaccaacccagatgcctattggtcaacgagtggatgaagaaaacgtagtgtataccagtatactatagaatactactcagccctaaaaagagtgaaataatggcatttgcaacaacgtggatggaatcggaggctactattgtaagtgaagtaagtcaggaatggaaacccaaacattgtgtgttctcactcataagtgggagctgagttatgaggatgcaaaggcataagaatgatacaatggactttagggactcgagggaaagggtgggagggggacgaggaataaaaaactacagcgtatgctgcttgggtgatgggtgcaccaaaatctcagagataatcactaaagaacttagtcatataagcaaacaccacctgttctcccaaaatctatcgaaataaaaaataaattttaaaaaatttaataattaaaaatctcctgctcaagttaccaagttcagatagtatgatatgtgaattctgctatttaagaaattattccaattttatacagactcctccgcagaatataaaaaaggatagctcgccactcattgtatgaaactagagtagccttgataatgaaaaaaactaaacaaggacactatcagaaaagaaaaatacagatcacttctgcaaatacagatcacttctgcaaacacagaagcaaagcatctgggggaaaccatcattaatcaaatctagatattcttaaaaattatttttataattgactagaacttttcctagaaatgcaagataattcaacattagaaaacctatgaatgtaatttgtcacactaacagattaaggtggatacaaaccctgtatgatcagagaaagcactggaactgtagcacaagcacagtcagccagaggtgagaggagcggagataagattgcagagttgccgatggctgaaactggatgggcatgtagggctcattgtactccactctgtgtatgcttcaaatgtccgtgataatttttttttaagtaagacctaacactccttccaaataaaaatgcttagcagattacagtagtatcaggggtcttagcacagtagaacaagaaaaaatgaaataaaaattgtcgggattgacaagaaagaaaactgtcattatttacagatgaaatatttatacacagaaaactcaagtcctgtcatgcagatagtatttacatagaaaaacatgaaattggattcctaccttgtaccaagtgtgaaaatcaattctagataaattaaaagacaaatgatgtagtatgaaaggacaaaggataaaaacaagtaactcacaggagaagaaactatgatcaattttactgcagtcagggaaatgcaaattaaaccctcaatgaaacaaccatttccacctgtcagtttagccaaaattaagagatctaacaatattaagatttagagaagaagtggagaaattagtgtttctttatgctgttggtgggttggtagaaccactctgaagggtaattcattatatcccatccactggaattggcacgagcagttcctgccaggtatagttttttgcccaagtgcacaaggaaacatgtaaagccatcctagcagcattatttgtaataacaaaaaactgaaaatcacctgcatgttcaccatcagggaaatggataagagaagtgtgatctgtttgtgcagaagggaaaatgagtgccttagaactaaatgtatttatagcgtatgatactatttaaggatgaacaatgtgcaaaacaatgtcatatactgtttatgatatggatgtagtaaacgtataaaagcttgcacaggaatgattagcaccaaattcaggacacagttttcctggtggtggggtgggggttgctgggaggtggggagagggagaggaatgagactggggagttctggccacattctgatgttttatttcttaagctgggtagtgggtacacagaggtttgttaaattattcattgcatctttcggagtgtttaaaatattgtgtaattgaaaaataaagggatacgaaaagatgaactaactaaacattgaccaaaagaaagccagtgtaggccgggcacggtggctcatgcctgtaatcccagcactttgggaggccgaggtgggcagatcacttgaggtcaggcgttcgagaccagctggcctacatggtgaaaccccatctttactaaaaatacgtaaaattagctgggtgtgctggtgctgaggtgggagaatcgcctgaacctgggaggcagaggttgcagtgagctgagatcacgccactgcactccagcctgggcgacagagcgagactccgtctcaaaaaacaaaacaaaacaaaagaaagctcatgtattaatatcagccaaaatagaggtgaaggtaaaaagaggacggatgagaataaagaggcatattacatgatgaaaagaggacgcctccagaaggaaaacactgcagggcatgaacttgcaggacctaacaacctggcctcagaacattgaccaaaaacaggcagaattacaaggagaaataaaaactttaccatcttataagagatttataacatgtctctgtcaaactgcaggatgaaactgacaaaagattagaaaggatctaaaaacatgaaccagttgtcacatacagaactgtacccaacagatagtgaatagaatattcattatttggggcacttggaacatttgcagactttgaccatttattaggtcactcaggaaacttcaacaagtattaattactgtccagctgggcacagttcctcactcctgtaatcccagcgctttgggaggccgaagtgggcagatcacctgaggtcaggaattcaagaccagcctggcgtggtgaaaccaaaatggcgagaccccgtatctactgaaaatacaaaatttagccaggtgtggtggtgggtgctactgtactccagcttgggtgacagagtgagactccaactaaaaaaaataaaaaataaaaaatgaatattgctgtcctgcagagcacaactttgatatcatttagataagcaggcaccgttaatgaaaagtcatttaatatctttcccatatttgtaagttgaaggatttgggagtaaagaggaaatcagaaatcacgatggccattacagaatatttagaactgaacagtatcaacacttgtaagaggaatccgaaacaacacttaaagaaaaacttataatcttaatgcagttatcagaaaaaaaaaaggataaaaaataaacaagtactcttaaaaaaaaaagtgtcttgccctgtcacccaggctggagtgcattagtgtaatcatagctcactgcagcctcgaactgggttcaagtggtcctcccacctcagtctcccaagtagctggggccataggcacacaccaccatgcccagctaatttctattttttgtagagacgtggtctcacaatgttgcccaggctggtctcaaactcagtgggctcaagcgatcctcccacctcagcctcccaaagtgctggtaatgcaggcatgagccacagagcctggcttaacaagtacttatatgaaaaatctagaagaaggaataataaaccaaagaaaaattgaaagcagatgatgctaagagtagacatttgttgtacagatcactgaaacaccaagataacaagcatgttcatgaagtagataattgtacagcgactgatcaagggaaaaaagcacaaacaaaaaatgtaacccaaaagggagtcgtaactataggaaaatgagatttttttttaattccaaaagaatactttggcaactttatgccatgagattggaaagcgtagatgaaacatgctttttttttttttttgagatggagtctcgctctgtcgcccaggctggagtgcagtggtgcgatctcggctcactgcaagctccgcctcccgggttcacgccattctcctgcctcagcctcccgagtggctgggactacaggcgcccgccactacgcccggctaattttttgtatttttagtagagacagggtttcaccgtgttagccaggatggtctcgatctcctgacctcgtgatcagcccgccttggcctcccaaagtgctgggattacagacatgagccaccgtgcctggccaaaacatgcatttttataggaagacattaagtggattaaattagctcaagaagaaattttgaaaacctggacatttcataattataaaagaaatttaacagacagtcaaagttctcttcctatctttctgcctcctgcctggggcccagtcattataaggcgagtttcaccaagcctttcaagaagaaataataactatttgactcaaacaatttcagagaagggatgaaatcatttcatgaggctagtacaaccttgacaccaaagccatgcaaggacaatttaagacaaaatgcagaccagaacgcaagctccatggggcagggtctttgttttatccactgaccatcctaagcacctgaatatcgcccaacacggcaggtacgctaatgtctccccagtgaaagtagattcattcaaatctcatggcataaagcttccataatattcttctgtaattaaaaaaatctctttttcctatgttatgacccccctttcgtgttacaatttttatttgtgctttttttcccttggtcagtcttgctatacaattatctacttcatgtgtctccttaaaaatatgctttttacagtcttgttattttggtgtttttttatctgcatcacaaatgtctgcaaataatctaaaatctattaaaaaatcaaatcagctgcatatattaaaaaagaacctaatagctaaactgtgttcattctagtaatacaagaaatacaaataatacaggaaattgtcagtataattcctaatctctacaggttaaaagagaacatgtgtcatagatgcagaaaagtgaaacattgataaaaataaactttaattcatgataaaaaaaagtcatactaagaattgacaggagtttaaaaaaatctggtaaagagtatctacaaaaaccctacaaccaggatgggtgatagctaatgggtatgagtttctttttttgaagggatgaaaatgttctaaaatggactgtgataatggtgacacatatttgtgagtatactaaaaactattgtatacactttaaatgggcgaattatatcccaataatgctgttatttaaaagagaccatagcaaggatcatagataatagtaaaagattagaagtattgttaaaaggaaaataaggatgcctactattcaagcagtcgaagctaatgtcgtaagaaaaaagaaagaagtaaaaagactgaaaaggaatagaaaaaaactattattatttgcaaatgtgattatttactatagaaaatcctagataatatattagatataataagaaaattcatcagtattgctgaacataggataaatgtacaaaaatatagcttttctatataataaataacattattcaattagaaaattcaatttaaaagaaaggtctcattcacagtagtaacaaaacttccaggtacccagaaataaatctaactaaaattgtgcaagacttttgttgcagtaattatgaaatgtcattcaaggccttaaggagctgtatgtgtgcagagagatgtttataagtaggaagccttaaaatggtgaaggtgtcagttctccccaatttaatttatgaatcaacgcaatcctgatccaaattccaatgggactgttcttggaattcagcatattgattatatggaagagtaaaagtccaagaaaagacaattcaggaagaagaaatttgtcctaccatatatcatgactttttataaagctatggtaatgaaaatagtgtggtatatgtaaaaatgaaatatcaaaagaacagaccagagaacctggaaacattccaaacatatatagaaagttggttatatgagaaagatgtcattggaaatcaatggaggaaggatggactattcaaaaatttgggtctgggaaaattggctttccgtatgaaaaaaattggatcatcatctccatgcatgcacaaaacttcagttggattagaaacctaaatgtaaaaaatcaaacttgaaaatgatttaaagatgatttaaagagtaagaggccaggcatggtggctcatgcctataatcccagtgctttgggaggctgaggtgggagtatcgcttgaggctcttaagttcaaggtcagcctgggcaacataatgaaagcccatatccaaaaaaaaaaaaaaaaaaaatagctgatggtgcacctctgcagtcccagctacgtgggagactgagacaggagaattacttgaggccaggagtttgaggttataatgagctaggatcgtgccactgcggcctgggcaacagagcaagacccagtctttagaagaaaagaaagaaaaaaatatatattatgaaaatatctttatgatcttggatggagagaaatttcttctcttttcttttcttttcttttttcttttcttttcttttcttttttgaaatggaatctagctctgttgcccaggctggagtgcagtggtgtgatcttggttcactgtaacctccgcctcccgggttcaagcgatttttctgcctcagcctcccgaatagctgggattacaggcacctgccaccatgcccagctaatttttgtatttttagtagacagggtttcactgtgttggccaggctggtcttgaactcctgaccttgtgatccgtccaccttggcctccaaagtgctgggattacaaacgtgagccactgtgcctggcccaaatttcttttttttaatggagatggggtcttgcgattgtgccactgcactccagccttggcaatagagcaagaccccatctccaaatttcttttttttttaaatggagatggggtcttgctctattgccaaggctggagtacagtggcatgatcatagctcacacaactggctcaagtgatcctcctgcctcagccttctgagtagctgggactacaggtgcgcactaccacacctagctcattaaaaaaatttttttgtagacagggtctcactatgttgcccaggctggtctctatctccaaagtgttgggattacaggtgtgagccaccactcctggccgtgtgtgtttgtagtgaaaatatctttatgaccttggatggagaggaatttcttaagatgcaaaaagcagaaaacataaaggaatagactgataagactgatatttaattacattaaacttttttaatacaaaaataaaagcaaacaggagactaaagatatttacaatagataatgcaaatagagtattagtatatacaagaatacataagcaagtctcaaaagtcagtaagaaaaagatgagtcatcagaaataggagctggggggttgaaaggcagggcacagaagagatctaagggcccctgggcaggagaaatgatcaaactcacgggcttgccttttttttttttttttttttttttgtagaaatggggtcccactatgtcgcccaggctggtgtcgaactcctggggtcaagtgatcctcccaccttggcctcccaaagcgctaggactacagacgtgagccaccacgcctggccagtgcttttaagccctttcacgtttatcagattgggaactgtcaaagggcgtgacagtgccatgggtggtgtgaggatgtgatgaagaaccatcctctgctgctggcgggaatatgatttgggataaccattttggaaacatctagtgaagtcggcgaaggtgtgcatagcctacatacctggcagctgcagttctggagaaacttcacatgtgcacaaggggacacggcagcaaaaacccggaagccactaaaagtacctgtgagaaggaaaataggtaaatggaaggaaaactgtgtgatggtttacacaaataagtagatttatatgtatcaacatggagagccgggtgcagtggctcaccctggtaatctcagcactgcaggaggctgagggggggctgattgcttgagcccaggggttcaagaccagcctgggcaacatggcaaaaccccatctctactaaaaaatacaaaaaattagctgggcatggtggcacctgcctgtggacccagttactcaggaggctgaggtgtgaggattgattgggcccagaaagcagaagttgcagtgggccaagatcacaccactgcactccggcctgggaaacagaacaagaccctgtctcaaaaaaaaaaaaaaaaaaaatggagaaacctcaaagctgtattgttgaatgaaaacagcaagttgaagaatgatgtgtagtctggtaccttcctgtgcatgtttagcacgtatgcagtattctgtttatacatacgtgtatgtgtgtgatgtgtagtggaaccctaaagacttggatccattcatccaacaagggactactatccacaatatacaaggaactcaaacaactcaacagcaaaaaaaacaaataatcacatttaaaagtgggcaaaggctctgaatagacatttctcaaaagaagacatacaaatggccaacagatgtatgaaaaaatactcaacatcactaatcatcaggcgaagacaaatccaaaccacagtgaggtatcgtctcacccatttgggatggctattatcaaagacaaaattaacaaatgctggcaaggatatagagagaagggaactctctcacactgttgatgggaatgtaaattagtccagccactctgggaaacagtatggaggctccttaagaggagccataccacaaaaatcccactgctgggtgtttatccaaaggaaaggaagttggaacatgaagtgctgcctgcctcctcatgctcatggcagcactattcacagtagcaaagataagggatcagcctaagtgcttgtcaacggatgaaaggatacagaaaatatggtgtatatataacagaacactattcagccacaaaaagaatgaaatcctgtcatttgcagcaacatggatggaagtggatgtcattaagttaagtgaaataagccaggcacagaaagagaaacttcacatgttctcactcagatgtgagagcaaaaaagctgatctggaggtagaggttagaatgatggctaccagaaggtgggaaggctgtaggaagaggggatgaaaagagggtggttaaggggtacaaacacagttagatagaaggagcgagttcctagtgtttgatagcatggtagggtgactataactaacaacaatatattgtctatttcaaaataatcagaagaaaaggtttgagatgttcccaacacaatgctaaatgtttgaggtgatggatatccgaataccctatttgatcattgcgcattgtatgcatgtatcaaaataccacaagtaccctaaaatatgtacaaatactatgtatcgataaaaagaattaaaaaacggcagggtgtggcggctcacgcctgtaatcccagcactttgggaggccgaggtgggcggatcacgaggtcaggagatggagaccatcctggctaatgcggtgaaaccccgtctctactaaaaatacaaaaaattagccgggtgaggtggtgggtgcctgtagtcccagctacttgggaggctgaggcaggagaatggcgtgaacctgggagacggagcttgcagtgagccgagattgcaccactgcactccagcctggatgacagagtaagactccatgtcaaaaaaaaaaaaaaaaaaagaaatttaaaaacccccacaaataaatagaaagtgaaaaaagaaaaaagacttggatctgtgtcagatccctggttggagttggtcacggggagggggaccattgcacatggggcaaaatttccattttgggtgggggacacatgagtgtttattattttattttcttgtatgtttccaaaaattaaagtagaaaagagacatggctactaggacaagggttgcatttagccaggctgtgaggctagacccaccaagtggagtggcaggaactgagagcataaggctctgcttctgctgggtggccgtgtgcagcccagtcccctgtgaacctcggcttccttgactgcagtgacgtggatggcgctgtttcgtctctccatgcctgatctcactgctgccctcctcgcctctgcccacctccttctcctgttgggagctcccttttcatttctggctgaaaacctagagtatgttagtcttttaagacccagttctgcagccatgtccttctggaagcttttctggaggaccctgggatgcccagaccttcggagacagcatcatctaaagacctggatgtgcatgtgtggacgtggcagtgcgcgtggacgtggcggtgcacatgcactcatgtgggtgggggtgcgtgtgtgtggggaaggcggccatgggggcttgccctgtgttctctccatcctggcagatcctgacgggagaggactggaatgcagtgatgtatcacgggatcgaatcgcaaggcggcgtcagcaaaggcatgttctcgtccttttacttcattgtcctgacactgttcggaaactgtatccttctgtggggctggggcagagggtggtcagtgcttggccctcctcttctccatggccaccacgcggatccctccaggaggactaggggccgtggacgtgagaggtgcattctcagagctgagtgcagatggagaacattctgcaggtggccggagcgcagggctctggaggctttgggactcagcttgagggagcatgagctgctgcgtgtgggggtatccagaggtgggggtgggtgcggccagcagcaggcccaggacagactctgagcagcagtcggggagcctcacactctgggcaggtgggtttttgttttcactttgatttaattgtgtacttaggttttggcactgggctttaaaaaggagcccttccccctgctgataccatcccctttgcagagaaatgtaaggaaaggttttctgtggaggatgtcagttgggctgtttcaggaccttgagtcagagggtgagtctgtggggtcagagcgagcccagccgccggtggtgagctctgccctagcaagggaccatgatagggacagggctgtggccaaggaagatctggagggagaactacagcattcgtggtataggcaagggtgagggctatgacaggcagtgtgagtgggtccccctgtagctggggtgggaagttcaggcctagaagtgtctttggttctcaaactcatctgggcatcacagtcccctgagggatggtaagcctggattccagccctagcccagggtgtcagaggcagtggggctgggctggggcctgagaatgtgcattctcacaggctgcagggggagcccgtgtttctgttctggggaccccactttgagaactgctgtgacagaacaccccacagggccccgaggagctggagacaatgtctcacagtcgacctcccggctctgcttctaccccgaacttctcacacacgatggccactccaccccgtctgtctgtcctcgtctctgcctcactggtgccggtgccctcagtgcccttgcagacttcaccttctttcctgtctccatctccctggctcctcattccttgctccacctctcctaggctggcccagcaggggctccctctctcagtcttgttagtcacggggtggtccttaggctgcagctcagggcctggtccccagagtgggggatccagccttcctgggaagttgagtgtgtgtgagcctaggaggggctccagagagcctgagggggcagtgtctgctttggagatgggtggccctggggctggcaccggaggcaccaaagaaaggcagccccggttgtcagagagggacggaagcctcagacaggacagcggtgtccagaaggaggtgcctctgcctcaagacagagcagtggccagtggttcaccacagctgagtctgaccctgacactgaggccaggcatgctggccacgagcgtccccctccctgtccactcagcgttagtcctgctggatcccaaggggcatggcccttggtcctgctttctgggcatggaaaggcctctgaggtgtcagtggctgtggctggtgcctggaggtgtcagcctggcctcagtgtcctgccctgtgggctctgctggagctctgcgtggactcacctgtgaggctctggcctggggtatgcgctcccttgacccccagggagggggcacctgtccagccagagagggacctgacctgccagggtcactgctgttggcctcatacagagccagctgctattcggcctggcagaggccagtaccacagggagagtggctgtagcctgggcaggggtgagtcgcaggcctgtggtgaaacgggctggatcacgtggagtgcaaggttctaacgggggcagcttcctctccctacagatgctgtggtgcatttggcagcttctgagtcacttttggttgtcagcactgatggggaggggctgatggcctcaagtggacggagaccaagggtgctgcctgccgtcccatagaggattgcccagccccaaatgccagcagggcctgggctgagaaacctggagtgataaaatggccaggagggcacccccaatggccagggtctggaggggcagacccaagtcacagtcggggtcctgactatgtttgtggtggttctgggaaactgtgcaggggcagggaggtgagagttcaggaaaaggctgcttccagtgatgggtgaagagttccttttgcaaagaaaaacaccgtgatgggacaaggacctggtcccgcgagctttgagaaggaggccgcacaccccaggcggtgcctgtgccggtacctgtggcaggtgcttccctttgggccttggtttcttcatttctaaaaggtggggcagcacctcacactgggtcctgggaggtcagttgaggcaaggtgcagtcccaggaaccagatcatgccatctgccgtctccacggcctgacgtgagtcctgcaatctacggagcggatgccgcaaagaagaggccccaggacaccatgcgggaaaaggaaatggaaaggaggggaaggtagcactaggtggcatctgtgggcctaggacttggggcccagcatgtgctggccacaggtgggtttgcaagctcgtggtttgtctgaggtggtctctgctcacaggacccagaaggcagtggagccccacctggagcctgtggagtaggagctgtttgtggggaggcttcttgtgctggccggggcttggggagttgggagcacagcaggcagaccatgggccctcgttaggaggcagaggcagatggctccagcacagcctctgagctttgctcctgcacagtcagcccgaaagagctgggttgggggaagaggctcaggtgggcattaggggaggctgggtgatgggaggctgagcaaaggagggattggcagagaggctggaggtgaggatggaacagggggctggagggcctagtggctgggctggagtgtgtctggggatggggccttggggagctggtaggtgccaagggaaggaggctggaggctggttgggatctggggagatgggggaagctgcagtgtgactggggccatgtggggcagaggttcccttcctcagctggacccaaccagacactctgctgaatgtctttctggccatcgctgtggacaacctggccaacgcccaagagctgaccaaggtaggtggcgacagggagggaccggtgtcagcccatgtcacttgaatgtggccgcagccaggaagagtctgggtcctgggttagggcctcgtgtccaggagcgttgccttgggtcctggcgggcagaggctggtctgtcactcaggggctggaggctggagctgaggatgcagggagagccaaagccccgaaggcagatggacaggcaggctctcagggaagccagcacagggaagaatggcctgaacggcagggtgtgctgggagcaggaggggcctgagcaggaggagcagctggtggccctatcccagcacagctgtgccacagtgggacagctgctgcttcaggcagtgctcagcgggtgccattttaatattcatctcatccctgagcctggtgggggatgcaattgtacatgtctccctctgtgatatccctccggatgacacagtcccctcctggtcatgctctccccagccctggacacttgtagtgtggccacctgccatctcagtcgcaggcttgtgtgttgactcaagccctagctcctagtagaggtggtgctgccttctggtttggtgtgaaccacgctgcaaacgtcccacgtgcatgctctgcacatcagtgtgtacctgtgtgtcaccatgtatgtgtcactgtgtgccctcttctgcctgtgcaccatccctggacaggtgtctgcatgcacctgtgcatgtctaggggtctgacacagttctgtcactccagtccagtgtctctccatgccttccctgttccggggctgagagaggcaggttcaggatttctgtccatgggcagcagagatgcaggtgtgccacagagcttctccaagagtgagtgctgtgcaggtgcccctgctccccccagccgagctctccaggaggggggtgtggtccatgcggtgtgccagctgcagcctgagcctccctttgcttctgctcagccttcttactcccacgcctccagacctgggccatggccatgcctatgcctaggggcccggattcctccctggcgctctggtttctggcttctctctgttcctgtcttcagctgggccgcttgggttgggggagcccaagcccccacagagctctccttggtgccggggttgccttggagcccggggccctagctgtcctgggtgggctgcactggagcgctggggccccactgtctctttaagttctgtcatgaaggaagatgcatggaggaagccatgtccttggggccctgtgtccacatacatgtaccctcattggtggccccccttttgtgtaactggcctcatttaggaatttcttctctgaggatcggggccactgggggcctgtctgtgtctggctgtgggcatttttctgggctgaccaagagccgcaaagtttatgactcgaccatccccttcccttatattcccataatattcccacaaaagcattacagcactatgtaccttttgaagcgaggataaacttgaatttgttttagaccttccaggggactttagaacactccctggagtgactggcaaagtccctgccccagagggtgggaagctggatgcagccggatctgcgaggagggacctgggtgtgggtgtttcacgctgggtctggctttgcctcctctctgggcttgaagttcgaaggtctctcctctgtggagggaaattcgcaggcagctaacaagggacttagtttctgccagcgttgcgccccgaatgcagattcaaggacattttagggaacactgggaatgctggctcccaggggagccaggtgggtctgggcttcaggattttgaggaaacagtggtggccccagcagtccagatggacaacgtggaagtcgtagcttccattctgaggcctgtggtctcagccgagaactattgatccggaacccaggtgccgagcatgttggtcttgtttagtgacttagggtcagggccagagggggcagaggaaactgcacctgcctgcacatgtgcacatgcccagccctgagggcaggagccatgtgaagttcagggccaggcactgcaagtggtcacccaggagtgggggagacagggagaggcttctgacagccacagctggggaaatggggacagacatggtctgctggctccaggcagaaaagctcaaagatggtgcgtggccccactggacaccctcctggtggcagtgcttgtgggcagtgctgggtcaggacttagccacaggtgcagagcctcttgcccttgctcttggctttgttaaagtgtgacagatgctcctggggggacaggtgggacaaaaggagggacagatttgcatttcagtgggcaagtttgaggtgccatggtacagacaagctgaaggccaggcatggtagctaacacctgtactcccagcactttgggaggccgaggtgggaggatcacttgagcctaggaattcaagaaaaattaaattaaaaaaatttagccagtcgtgatgacacgtgcttggagtcccagctgcatgggaggctgaggttagaggatcacttaagcctgggaggtcgaggctgcagtgagctgagattgagccactgccctccagcttgggtgacagagcgagaccctgtctctaaaaaaaaaaaaaacaaataacaaaaaacaaaacaaacaaatggaaatatccaggcagtggctgggtacctgggttagagctcagagtaaggtcaggatagcacagaggtgaggccgtcgcctccagggagacggcacaagcaagagggcactgaggaaggaatcctagtgaccattacctttgagtcacagacacagaagggaaggccctggagagcaccagagacagctcctgtggaacaggtcgtggggggccacattcactcaggggttggctgcctgtctccactggatagagagcagcactgtgtattttttgaggcccctggaggaagagctgatgttatatatagccagtgttagagtggctataacactgtgaggggaactggacatttctctttgctcaaacaggatgaagaggagatggaagaagcagccaatcagaagcttgctctgcaaaaggccaaagaagtggctgaagtcagccccatgtctgccgcgaacatctccatcgccgcgtaaggctcctaggagtggattgtggggtggcagtggggctgctgcagggtcccatggctgggccctccccagggcaccccttccagaggcttcctcagagggcctctggccttggcgggtgaggacacagcccctcctcggaactgggatgagagcctgggggctccagggctttttctcagtatgagcagggccagggtgtggccaggcacagccctcacattgtggctgggattgtctctgctgtgatattcactccctggatagcctcagggtggctccaggcccctccccaggcaactgtgaatcagttgggggagggagtcagtaagttgcttttatgcacagcttttcagaaatttattttatgagccaagagattctaggtgatacctgagcagtctgagagacttactgcagtttccaaaaatgtctctgcaagtgtttggtactgggacagatgttagaggaagttattctggcgaaaactgcgtattccatagaaccatatttggaggtgttaggggctttagagtttgggcaaagtgtccagcccagggccaaaggctgcactgagccgagctgtggggaggtcagtccctgggaagggaggcaggaaagtctggcccatggcctggtcacagggtgggccacaagagtgcagagatgcccttactgggagcttgttctctaggcccagctgaatttagctctggagccactagctccgtctggctgcatgcccaccccccacacctcccattccccatgctgatgggcgggccccagctcttcagccggccacccgccctgccgtgaacacggaacacagggccgggtgcagccacaggtgcatctgtagtgacgtgtgtctgcacttctgtgtaagcatgttggcatgtggatgagtgtgctaggtatgtgtgtgtgatgtgtgtctgcactgctgggtaagcatgctggcatgtggatgagtgtgctaggtgtgtgtgtgtgcacttgagagttgcacagtgagcatgtgtgtgagtgcatgtgctgagtgtgtgcacccccataccagccctgatcctgcctggagggcaccaggaagatggtgtttgcggagggcctgtctctaagcctagcagaaagtgctggtctttggggcagaagcagctagaagaggctgcagcccgccggggactcaggcagggatgggaggggcctgcaggggaacttggcagctgtggacacggtggccatcacgcagaagactgctgggggctcagtcctcagttgtttaatttcgatctttcattgtcttggccaattcggttatttggttcattagttatttagtccacttagtttggttacttggtccaggggtttgctaccagggctctgtgagctctgcaggtgggtggtctgcagtagatggggcgagtggtgtgttcagctcctggcctcgcgcaggcctcgtgttgttctcctgaagacttgccttctctgctgttcctggaggcgagcacttgtcccttgacccctgctgcctgccggccctgcctcctcctgggggtatgggagggtgtccactcccatctggcctgagaccttgcagaagaggctgccaggtccctggcagtcatggagcctgagtcaggctgcctgaaaaggaggctggacactcttccttatctgctgccctgtcctggtttggagacactgctatgcaggaacaaggcagtagactggcatccttgggcacagtgtacatcgacaccacctgttggcctgagcaccatgctgattcctacgcgaggaaagagcttcttttttcccgggggacccctaggtgttctgcctcacggtgggtctggagccaggtgtcagctccagtgccagcatcctcaactcaagcaggctgcagccctcacacgtggcaaggggcagccggcccaagccagcccgaggcgtccaggtgtcagcccccatggtccctgcctgcggtgcagctgtgggccctcatcctctgtggcatgtcctcagcccactggtttggacatgacagccagtctgatttccgccacaagagaccctgcaggaatcaaccttgaggggtttccctcaaggagggccctgcacctggcgaggcctggccctgctgctgctgtttgcgtgcctgtgttgtgctgagacctccgagggctgaaagctgtctgtcatctgtcctcgtctgcttcctgttctcctggtgggacgagcagcgctgcctcctgccctgctctcatttccagcaccttgagctgctgggctgtgcgagagcagtgcccttgagtacccttcacccttctgcccccaacagctgtgctgcgtggcctgcggagcggggccaatgccgggcttggtgccctgggtgctgggaggacttggggtgtccttggtgtttgagaggttctcagtgatgctctgtttggcttgacacagacggtgccagaacatgcctcagaagggcaccctagcgtgtcgcatgcagtgctgtgcgtatcctgggcctcaggtgacagctgcttgaagggacactaaggtgggcctcaggtgacactgcttaaagggacatgtcttcctggttctctgctgggtcagcctcatcctcacatgaatttctgaacactggcagcctgcagagtcacactgacactcacacacacacacatactcacaaatacatataggcaagcacacacacaggcacacagactcacatacacacttatacacaagtacacacagacacacagtcacagaagcacacacagaatcatacacacagactcacacagacacacacacacagacccaccctcacaacactcacaatctcacacattcagttataatcatcccacactgtcaatcacatacacacataatctcacacattcacacacagtctcacacacacagtgtcacactcacacaccctctcacacacatgcctgtttgaagccagagcctgtgggcaagtaagctggtttgactgcccacaaaggcacagagagcttggccttgagaaggaggggctgcagcccacctggccctcccctgggaagttaattggagggaaatggctgtaaagggagctttggtttctttctgttggttttagaaaagcctttgaaagtcacttggaaatggctggagctgcatccaaaaggaaggtgggttggcgtgtggcttgatttgccctggaggtgtcctggtggcccagaggcgcctgggttgcagcctggggagccctggggctggaaccagagtggggtccaggtgcttgccgggaagtcaggtgggttcggcagcagggaccaggcggcatctccggaaagggcaccctcgcctcctttgttagcctacgctgccccatctcgagggccgggagacggtgcggtcagcctcccgccgcagggtgcgggggcaccctcgcctcctttgttagtctatgctgccccatcttgagggccgggagaccgtgcagtcagcctcccgccgcagggtgcagggggctgtttggaactgcaggaaaatcggtgttgggtcttcccagccgcactgcctgtcctgggcagtgtgtgctgagtgatggatgggcccccgagctaatggcttctgtcttccaggcattacagggtttgctgtctcacttcagtctcacttttctgcatgtgtggaattggttctcaacttctctttcaccctgaggtctcggctggtgcccgtctgacggacgcgtctgcggcctcctgtccagatgcacatggcagcctgcgcctacactggcgtggctctcagtgtcactggttctctcagaactctgtctctggttttctcacttctgtctgttctgttttttgcatgtgcagttttgtaaagcaagctcgaggtactgtatctcgcagctcatctgtctccagcgtgaactcaccgtgagtcgctctgctacgatattccatccatggcttcatgataactacatgcagacaccttccttccactcctaactctgctatctcaccgcaagtcatttgcttcatggggcagctccaggccgggcttctgtggcctgagcggggaatggtgggcttgctccctgatgtccccaagtcctgccacggggtcagaccctctgcgctcagcgcctcctcctttccctcctggtctctgtctttttgtctgctgcctgttgtgtccgctcactccggtgtctcgagtgtgtctgcttctcctgagtggactgggcgtcatgggttcaggtctccttgtggttcccatgaggtcagggccctgtgagcaggcacagcagagagtgctctttaggggctcactggggacgtttatgggtcctcctaggccccttacttgggagggactgtgtctgtgattctcaggaagtccttgttctagcaagagcagagagctgttgtccacttgggaagctcacagtagaccacccagggcccaaggcagagacacggaaactccagggtggccctccagggagtgactggctggcatcccctcgggcagcttctcatggggaagtgctcatggatggctggtccgcaggggcttcccctggagggcaaggccaggccctgcaggtgaggggtccctgaagtggtcaggtgcagttaggccacctgccctgatggaagtggccaggtgcagttaggccacctgccctgatggaagtggccaggtgcagttaggccacctgccctgatggaagtggtcaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgcagttaggccacctgccctgatggaagtggccaggtgtcctgtccctgtcctagtggtggtgaggcccctgccgcccccgccctgcccagtgcttccttgctggcagccagcatggagctgggctcagtctttccacgagcactgtttgctgctggctgtcagaggcactgatgtctcctggggcaagaaagcatgctggatcctgcatccatccgcggggtggaataagatgtaagatgcagatggtggccgggcgcgctggctcacacctgtaatctagcactttgggaggctgaggtgggcggattccctgagctcaggagttcgagaccagcctgggcaacatggtgaaaccctgtctctactaaatacaaaaaattagccgtgagtggtggcgggcgcctgtagtcccagctactcggtaggctgaggcaggagaattgcttgaacccgggaggcagaggttgcagtgagccgtgatcacaccactgcactccagcctgggcgacacagcgagactctgtctcccaaaaaaaaaaaaaaaaaaaaatgcagatggcaggtatccatggtgtcacaccagggctgcttcatattgtcagcagttccgggttgtctgagcccagagacctcaaagcagggccacagagcgccttgaggccacttccaagtcctgtagttccccacagcacccagctgagcatggctgagccctcctccctggaacagctgggttgtgcctaccagctgaggccaggacacaggggtgccagtcgtccatgtgacttccttaaagaacccttttaaaccaggactttgcctggattaatcaccagccacacttcactctaagttggtgtggatatgtgccagatagagcaaggacagagacaggggccaggggaggtgcaggctgacttaagacaccatgcagagaggcccggcacgcagattcagagacctaggggatacctccagagaggaacttggtggtgctggccgagtgagggcagatgcagacagtctctggtgacgttagggctgacagtggcagataggcccggaaggaacaggccaggtggaaccagtggggctgcggggggcgggcaggtgccctagcgtaggctgctcagcatgttgctctgcctgggtggtcacgggggagcctgccagcctgacagcgccctcagcccagcagacagcctggcctttccctgctccaggtgtttcctgggcgagaaggagccacacctgaatgcaagggtgagggcagagctatatggtctggagcccaccccaccttcacacagaccctgtgcctctgcatgttccccatggtcctcactgcctgtctttttggaactgcaatgctggtccccaagattcacggcttcatcagagcgggccaccctgctgaccaagtggctcagagcccaggcccctctcgggcactggagtggactgggaggcttgaggcagtgaacagcctccgccctcacagggctcctgtgcctggtgcaagcccctggggctgccttctgttttacaccactcagcactgttggcagtagagcccttttgtcttggtcccagctggggttggtgggtcttctgtgggtcagttgtagggcacccctgggagcaggggcagcacagtttaaatgcatcagggatacaggtcagggcctggggcttcaactgaggctgggggtctgcagacggcccctacaggtagccctgcctgcccccaccccacccaagctcccaggtgagacacagacaccacacttccgctttcattcgtgcaaagtgctgcccctggacattgctcccactgcagcctggacttctacaaaggggcaggatttattgttcacctgcctggggtgggccggctgcagggactgggctttcccacatctggctgctctgtctttgcaggtcagagtggtgctcagcggctcagggccccggagctggtggccgccggcctgggcctctgcaggccgtggttgtagcctgtgttgttagtgcagttggggtctggccaaggactcgtgtcttctttagaaatgtttttcctttttgcccttgcctgtgtctgatcctgactcactgtgggaccctgagcaagtaacatcctctctctaggctcagtatcttcatctgtgaaatggggacaagagtagcacctgattcttgaggtggttgtaaggactggatgaagtgggcactgcgcccagagcaccacgtggcagttgcaggacacagatgccatggccctcattgttggtgtagtcactgctgccgccaaggccatccagcagccttggaggctccagggcgggcctctggcctcagatgaggtttctccctggcgatggtggggcttagttttgggataataagaccttatccaaaggtggtcttactcagcagaaggcccagaatgcaaagggcttcctgtgcactctgggctatggagccccatgtgtgatgtgtgaatagaggaggtgcttgggcccatgacattggagtaggggtcaaggccttcggtagcccatgcagtgagggccgagcctggaccactggccatccctggtgctggagggctccgaggaccatgttctggctctgctcccagtagagggaggggctctccatggagtcaagagagaggagggcattggtggccacgggaggtggcatttccagcttcagacctgacttctgggctcctggtcactgagccagggggcagctgcggggctgcggctgaccacctcggggactggcagaggctctgcgtttgctcctgaaagggccaggtgctcccttggctgctgtctgctctgccacagcaactgccctctgggttccctggcaaacagccttttcacctggctggtggcctgcctcctggaggcagcgatggggaagtgcctctggagaaggggccgcgtgtcccgcccttcctgtagcagctgtgctggtgctgcagcaggggccagctcccagggaggctacagggcctccctggctcctgcctctccatccgtcctgccctttgtaacatgcccttccctcccgcggtggccttcctggccagccgcccacccacctgcttggcctgtctggtgcattcccactgtcctgtacccctcggcctccttgagccccccagggtcctcctgacaggctggtgctttcaccttgcgggtcctgtgggacaccgtggggggggggggcggcggggctgaattcggttcccttgggcgttccccacctgatccgcgtcccccgaggggtgtgggggctcccgcggccacgcctcccacctccctgcgccattactccattgctgtgtgtgcattgtggcctccctggagagcggcgggcgggcggcagacggggccgcgctcaccgccagtctccccgcagcaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccggtgagtccgcggctgggcggggtcagggagggaagggttggccggggcggcgcgggccccagcggtggctgcggccatggggtccacggcggaggctgcagccccggccacgctgccatgtccagagccgtcggggctggggtctctgcatgccgttcacgtggggtggtgacaatcctgccttgcagggttgacctgtaaaaggcttggcagggcgtgtatgctccgtaaaaggcttggcagagtgtttgtgctccgtgaatgccagccgttatttaagaagggagggcttaagggggaattgttgcgactggcttggaaagaacaaagtggccctgggagaagagaaagttggggattgcagtggaggaaggagaggcagaagggcccaagggaagcctgagcaggccagtgggctgggcgcagagcggggtgtgggggccaggctgtgtgaccatgacagaaagaaccccagctagcccagcttgctccctggggcaggactcaccaaccccgtgagggcctggggtaacagtggtccagtggccaagaccagcagtcgccaggtacccactggccacaaaccaaccagaatacttgccgctggaggccccagcccagggtcaacccagccgccgccctgtctttgtgtgtgggtgggtcagccccatccctgcctttcggactaaagacacggaggtgtatagagtaatttaaaaaacgtacagaaggccagagtagcagagcaggtggttatggatttagttggtctgcatggaggcttaagggttttggttgataggattttgctgatgtgcattattattattattattggagacaggaccgcactgtcgcccagggtggagtgcagtggcgcaatcatggctcactgcagcctcaacttcccgggctgaagcgatcctcccacctcagccttcccagcctgaatagctgggactacatgcacgtgtcaccacgcccagctaattttttaatttttgtagagatggggtttcgccatattccccaggctggtcttgaactcctgggctcaagtgatcctcctgcctctgcctcccggtgccgggatcacaggtgtgagccactgcgccgaggcctgatgtacattcttgattgcagggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtgagtatctccctgtgccagtggggcagggcccatcttgtgcaggtccagcaacccccattccctcctgctccacagcagccactggggacccagcctacctctgtgaattgttctcctggctggagagagagtcctttgctgtcaacatctgtcccttgatgtcctgttgatttctagtgccccagagataactgaggttgagctccattctccttccttcccaaaatatttgcacgttgccaactaagtgccaggtgctgtgttagagtgctgagagcatagtaggagggagacagtcttgtcaggaagacagaccacaaaacaggcacaactcttgatggttgcacaaaagctgctggctgaggactctgtccacggccttgactggggctgagagcgaggggctgcagaggaggaggctctccactgcgtctgcccatttgttcatgggcctgtgccatccctgctctgaggctgtgctcccaggcctttatttgagctgccttctttcctccccttgctcactcacatgctcggaacagcctttccatgcctgcctgtgtgcagtccctgagggcacaggggaccaagatgtcattcctgtcttgaaacctgtctaatagggagagatctgctggttacaaatacaggccccttacgtggtggggaaggtgcatgggcgtttcatgggcatcaaggaggagccctcctttcttaagtacagagaaaaaaggggtagaagagaggccatagaaacaggactcacatgaatgccagcagaagcatttaggtcttaagcagaccagacggactcaatcaggtgccaccacatgcatgcccatgtttgcagacggatctccacacacagatgtgtgcatgtccgtgtttgcagatgcatccgcacacacagacgtgtgcgtgcccatgtttgcagacagatctccagacacacacatgtgcatgacattctctcttgctcaggtgctctcacctggggcctgtggactggcgcacaattccaggtataaccatggaagacacagcctctaactgctcagcctccccttttcctttgcttccttggaggaaagttgcccttggttcattttcttgttcacttcccatgggcacaagtgagtctgcctgcccagctccctcacctgattctctgtggatcagcttgaggatgagcctaggttccctacctggcttttatctgcaggaatccagatgtgactcctccccaggctccctatgctcttccccacacccctgttggcaaccactgattttttcactgtccctatagttttgccttttctagactgtcatagggttggaatcatacagtatgcagccttttcagattggcttctttccattagcaatatgcacttaagtttcctttgtgtctttttgtggcttgacagctcatttgttttaagcgttggattaatagtctgtcttttgggcataccacagtttatttattcacctattgaaggacatcttgttgcttccaatttttggcaattatgaataaaactgctttaaacattcatgttcaggtttttgtgtggacataagttttcaactcatttgggtaaatacttaatagcatgcttattggattatatggtaagactgtttatctttataagaaactgacaaactatcttccaaagggactgtaccattttgcattcccaccagcaatgaatgagagttcctgttgctccacatccttgccaatattcagtgttgtcagtgttttggatttgagttattctaattaagcgtgtaatgatatcttgtttattttgcaatttcctaatgacatatgacgttgagcatcttttaatgtgcttatttgccatgtgtataattttctttgatgagattcctattcaaatcttttacccactttttattctggctgtttgttttctagttgttgagttttaggagttctttgtatattttggatacaagtctttcatcagatatgtgtttttgcaagcattttctcccattttgtggcttggtttttcattctcttaatgtctggtgttttcgattgctaaaaacaactgattgtctggtccctattattacttctactagaaacagaaatctaggctattagtttttatatgttgattatgtatcctgctacttttctgaatcctcaaattgtttattagtttcactgattccccctttttttccgagatatattatcaaaacttctgcaaatatacttctaactctttctaagtcttacaccactcattattatttttttgtctgatttcactatcagataacaatggaattactgggcattaccttgtttccgcctacattaaataaaattttggtttggggcctgagggatgtgtgtgtgtgtctgtttgtgtgtgtgtaaaattatgttgtggtatccattagttcctacttcagtaagtgtttttatctggaatagatgttgaattttcttgaagaccttttcagcatccatagagatcatatatttttttctccttagatatggggatttatagtaatgaattttttgatatgaaatatctttgcaatcttagaataaatccaagtggttattatatttattttgtaatatgccattggattctctttaacattttttgtaggatttttggattgatatttttaagcgagatgtgttctgtagctttcttttgtcacatttgaggatcataaggtttaaatatcaatgacatagagttatctattgcttaacttcacagctccattcctgaaaatcaaatgttctaaaagagggtctcatttccactcccccccaaccttttttttttttttttttttttttttttgagactgagccttgctctgtcaccctggctggagtgcagtggcacggtctcggctctgcctcccaggttcaagcaattctccttcctcagcctctcgagtagctgggattacaggcgcccaccaccacacctggctaatttttgtatttttagtagagatagggtttcgccgtgttggccaggctgatcttaaactcctgacctcaagtgatccacctgtcttggcctcccgaagtgctgggattacaggcgtgagccaccgtgcctggccccattattttaaatggtaaaacattataatgtgttatgtgtccgctaaaaattcctaaccgattttgtaaaatataaagcacagataaacaatgaaaactaataaacagtcataatagaacataaaatgcttcacatattgtttcctgattaccagttaaaatagctagtaataagcaattgctttagatacctcctttattgaaacttgtacttttcaaaaacatccatacgattcccataacttactgtgaacaaaagttctctgaaaaggagtttggaggaaacaggctttattctagtgaatagtttgcaaaccaggaagatgcagccttccttgtaaaatgaaggcgcattccagaggagaaagagaagttttgacatttcctgcccaggtgcttaatcaagtccctttatgcaaatgaaggattcagacttgcttggtctgattggttgacacagctgagttctgattggtccatatagctgagctctgattggctgaggcaagtgaactctgattggttggttcaggtgagctctaaaagttcccagagttaaaaaggtgtgggttttctgggacctctattcagcatatggctgcttctctctgacttaaatgtaggctcagttagccacttgggatccatcttgaaggattagctctttcaggtttcttcacacaaccaactgaatttggaatcctgcctgagagttgttccccacattattttgttaaaaacattatattgacttttgggcatgtatacttttttttaacataaatgtcagccagaaaagtcaacaacactgtaatgaaagatatatatgttttccagaagcatgggcattataaaacttggcagtgctctattgggaaatactatccaaggatatattctgtaggatattcccgttattggttcataaaaataattagaatgtcttcttgtgctcaagggtagctcatgtagtataggaattatgtggtctttaaatatttgatagaattatcttgtgaaattgttgatgtctggtctctttttgtaggacagttcctttgtaatacccctttttttgtatggatgttggtctgcttaaacattgttgcctcttgagatgagtttggtaaattatattttccttagaaattatccatttgatctaggttttcccacttacttacatagccttaagagtggcttaaagttttaaaaatttccctctgtttcagtgtttttcctccttgtcatttctgatcctgtgtttttttgtgtttttcttttccttttttttttttttttttccagacagggtctcgctctgtcgcccaggctggagtgcagtggtgccatctcggctcactgcaaccaccatctcccgggttcaaagtgattctcgttcaaagtgattcctgagtagctgggattacaggcacgcaccaccacacatggctaatttttttgtatttttaatagagatggggtttcaccatgttggccaggctggtttcgaactcctgacctcaagtgatctgcctttctcagcctcccgaagtgttgggattgcaggtgtgagccactgtgcccagcccattttcatcaaatttcaaaattaactatgtaattttggcttatatttgtgctaggtgtgtgtttgtagattctttgggattttccagagagtataaggcatctgcaaatgaacagttttagttttttcctttctgacatacatgccttttatttccctgtcttcccttattgcactgtctgtgacttccagtactattttgaatagctgtggcaagaactgacatctttcctggagggaggattttgtctttcatcatttagtatgatattagctgtaaggtttttgggtttgtttggttgttttttgttttgttttgttttttggtagatgttctttatcaagttgagaaagttcccgttcattgcttttttttttaaagaatttttgtggtgagtggatgaatattgtcaaatgattttctgcatcaattgatattatcgtgtgtgttttttctgttatatggtattttatattgatttattttcaaatattaaactggcctttatcattatgaataaccctactggtgtataattatttctctatgttgctgaattctatttgctaatattttgttaaggagttttgcgtctgtattcatgagggatgttgctctgtagttttattttttgtgctgtctctgtctggttttggtatcagagtaatattggattcataaaatgttttgaattgaatggattgtccctcttctattttctagaggagattatgttgaactgatattaattctcctttaaatgtttgggaaattttgccaatgaagcatttcttttttggaatttttaaattacaaatataatttccttaatagatacagtgttatctatttcatattggatgagttgtagtagtttgtgctttatgaggaattagtcccttttatttaagtgtatacagttgtttgtgatgtttccttattatccctttgatgtctgcataatctgtagtggtaacttgtgtctcatttcttatattggtaatttgctgtcttctctcttttttctttgtgagtcttacgaggagtttgtataattttattgatgttttcaaagaaccaaattattgttacattgattttccctattatttttctgttttcaatttcttttgatttctgctgtttattatttccttctttctgtttgctttgggcttcttttgctcttcttttctagtttcttggggtaggagcttagattgttgatttgagtctttccttcttttctgctgcaaacatttagctctgtaagtttccctcttggcagctgcattccacaggttttcatattgtatattttttcagtcccgtttaaaaaatttcctttgagaagactcatggactgtttagaagtgtgttgtttagtttccaaacatttggagatttgcctatttctctgttattaacttctagtttgattactttatggtcagagaacatgttctgtattatttcagttcttttaagtttgttaaggttcgtggcccaggatgtgggatatcttgatgtatgttctgtgagcctttgaagggaacatgcattctgtgttgttgatgtgcattcctataagcattgtttagatcctgttggttgatgatgttattgagtatctttgtctacattcggattttctgtctagatatgtcaattgttgagaaaaggatattcagtctccagctgtaaatgtggatttatctttgctcctttcagtactgtaagtttttgcgtcatgtgtttgcagttctgtttttgggcacatacacatttaggatttctatgtctttttggtggactggccctttaattgttgtgtaacgtccttctctgtacctggtaatcttctttgctctgcagtctactttatcttatgtagatatgttcagtcctgccttcttttgattaatatgtgcatggtatatattttttcaaccttttgctttcaacctaactatatagttatatttgaagtaaatttcttgtagatagtattcatgttttcaatccactctgtcaattctgtcttttattttgcatatttagattgtttacacttagcataattattgatatattagggcttaagtctgttattttatttcttattttgtttttctctttctgtttttcatttctctggtttcctttttctcccttcctgtgggttacttgaatgtactttagaattccttttatctgtagtatttttgagtatatctcttctataggttttttaagacctcgtataggtttttttagtggttgccctgtgtattacattatatatacataacttactccagtttcttcatgtagtcattttaccagttcatgtgaaatatagaagctttacctctctttatatcgctttttcctcttccatttgtaatgtaattgtcttaaatagctcttctatgtacttttagaaccacatcagagtatgttataatttttgcttcaactgtcacacataatttagaaaactcgaaaggagaggaaaagtgtgttgtatttacctgtatttttactcctgttattctttcgtccttcctgatattccaatatttcttctttcataatttactttctgtttaggggaacttccttaggcattcttttgtggtaggtctgcgggtgacaaattctcttagttttccttcatctgagaatgtcttgattttcccttcattcctgaagggtattttcagtgggtatagaattttgggttgacagttctttttttttcagcacttgaaaaaaacgtgtgcctcttccttctgacctccatggtttctgatgagaaatccactgtcattcgaattgttttcttcctataggtaagatgttgtttatctcttgctgctttcaagatttttttccttgtctttatatttcagaagtttgattacagtgtgctttgatgtgagttcctttaagtttatcttgtttggggtttgctcaatttcttgaatttgtaggtttatatcttttgccaaatttggaaatttttcatcctttatgtctttaaatacttctttagttctgcctctttctcttttctttccaggactctgatgacatgaatattagatcttttgttatagtcccaaaggcccctgagctctgttcacttttttaagtctactttctctctgttgctcagattggatcatttctattattctatcttccagttcactgactctttcctctgtgccttccattctgctgtggagcccatctattgattttctaatttcagtcactgtatttttcagttctgaagtttccatttggttcgttatatcttctttttctttcctgagactttatttctttgctgataattttatatttttcatttgttttaagtgtgttttaaattatctgttgagcatttttataatgggtgtttttaaaatctttgtcagataattctaacatctgtatcatcttggtgtctgttgattgtgttttctcattcaagttgagatttcctggttcttggtgtgataagtgaattttggttgaaacctagactctcagtggtattgtgttatgagccctaagtcttatttacatcttcagttttagcttgtctactgtgatgccacgccagcaagtagtggggcatattagtcctttctcacactgctatgaagaaatacctgagaccaggtaatttataaaggaaagaggtttaattgactcatagtttcacattgctgaggaggcctcaggaaacttaaaatcatggcggtaggcaaaggagaagcaggcaccttcttcacagggtggcaggacagagtgagcgcaagacacttaataagaccatcctatctcgtgagactcactatcacgagaacagcataggggaaaccacccccatgatccaattacctccatctggtctctcccttgacacgtggggattatagggattacaatttgaggtgagatttgggtggggacacaccaaaccatattacaggggttgtagagagttgccccattattgacagatgggaatagaagtatggattcttcacttgagttccactgacattctaggggagaaggattactcattactgctaggctgggctgggagttttagctccccactaggcttccattcataccggcctgactgggagagataggagtatcttgttactgttccccagctggctggccttgacacagtggagatagaccttatcacctccaggtagcagtagaagtcctgactttccactagggcttgctccattgagtaagaggaagagattgtctcattcctgctgggtgagacgtgacgtctaggctccccgtgtgatctctactggcattgtgtgtattgggggtcttgttaccactagatagggatgaaagtccctgctcccacttggctctctctcagaccaccctagcaggggctttgggatggtggtgagggtggaagtctaggctccccacccagtttctgctggtataagtggaagtagggtcatagttttttttttttttttggcttgtgtgtgtagtttggctattgtttagtgattattgtctataagttttatatctcggtaggctgcccctttcctagtcctttcactagggagagctgggtttattgagcctttaaaaaatctgtgcctattggcatttctgggttgttgggttcactagtaccaaatctaggatatatatgaggcataaaagaaaactcaaataagaaacttattgttgtgtcattcctcaggtcccaaggtccctagccaatattttctttcttccttctacctgttagaatcttatatttgccttatatatgatgtgcaaggatcttgtagtccccccttatccatggttttactttccccactttctgttatctgaggtccactgtggtctgaaaatatttattacataactactctcgcactttggggccattattaagtaaaataagggttacttgaacataattactgcaataccatggcagccaacctcataacccagatggctgctaagtgactaatgcagtccaggtgggacagagcagaacggtgtggggtttcatcatggtacttagaacagctagcaacttaaaacttatgaattacttctggaattttccacctgcatcacaatgcctgtgtcattcacctcagttcgtctcatcatgtaggcatttcattatcttatagcatctcaagaaaaagatgaccgctggccgggcacagtggctcatgcctgtaatcccagcactttgggaggccaaggctggtggatcacttgaggtcggaagtttgagaccagcctggccaacatggtgaaaccccatctctactaaaagtacaaaaattagctgggtgtggtgatgggtgcctgtaatcctagcaacttgggaggctgaggcaagagaatctcttgaacccaggaggtggagactgcagtgagccgtgagctgtgatcgtgccactgcacttcagcctgggcaacagcgagactgtctcaaaaaaaaagaaagaaaagaaaaagatgactgccagtatctgtagaaactagtttcttattattttttaagtttctgatggattggtagttgtggccacttttatatttctgatagccttccctccctccctccttccctccttcccttgataagcccttttttccctgaagttttgtccacttaaatggtttatcaatgccccagtctttgtctttcttgatcttctctgttgtatttttgttttctgtttcaccagtttctgttcttatttattatttcctttcttctactttgtgtatgtgtactgtaatattctttctccaatttattagttggatactcagctcatgacattgagcttttctactttgctaatgtgtttaaaactttaagtttctctctgagagttattttagttatatattgaaagtttaaattttttgtttcaaatattttttccaagtgtgattaagaattcttgtttgattcatgagtttttaaagtaagtaggattttaaatttctaattgacagagatttctctatcttgttctcttttcctatgttttgcagttgattctgttattccttttcatatttcatcactccttatatttcggatcatccattgggtttctttcccccccgccccttctgcctgaagaacagctttcctaatttttttttttgtttttgagacggagtctcgctctgtcgcccaggctggagtgcagtggcgcaatcttggctcactgcaacctccgcctcctgagttcatgccattctcctgcctcagcctcccgagtagctgggactacaggcgcccgccaccacgcctggcttattttttatatttttagtagagatggcgtttcactgtgttagccaagatggtctcgatctcctgacctcgtgatctgcctgcctcggcctcccaaagtgctgggattacaggcgtgagccaccgctcccggccttcccctaatttcttttagtgaggtttgatggtggtaaattctcttggcttgcctgaacagtctttattttgccattgtttgtgagacgtggttttacatcgtagaaaattctcatttgttatctttatttcaacatattgagactgctccactgtcttctgccttctgttgtttctgttgagaagccagtcattcgtctaaattttttttcctatgtatgactgtcttctctctggggctgcttaaataaaatcaattttattgtggaaaattgaaacatacgggaaagtggagaaaatgcggtgaactcctgtgctccgtctccacccacattttgccaatgttgtttcacttacgcttcttcttgctttcttgtgtatcattttaggtgtaatacgccaataagcatgtctgacaattaaggatttatcatagctgtagagcattattacacttagcaatgttgacaataattccttaatattatctaacacctattccaagttcaaattttactagttatttcaaaaataactttttacggttggtttgagtcaggattcaaatgaggtttactcatttgggtttgcttaatctgtctaagtctcttttactttaaaagagttttcctctgcttattcatgccatttatttgttggggagaacatatggtttgtcccgtagaatttctcagtttggttgtttgcatcatggtgttgtttggtacagtcctctgtcctcagtgtattctgttacctggtaattagatccggaacagggcttctcagccttggagctgttgaagctctattgtggaccgtggcctctgcattttaggatgcctagcagcatccctggcctctgccttctcaatgccaggagcacccactagttgtgacaaccaaaggatgtctagagaccgttgtgaaagaatccaggccgggctcagtggctcacatgtgtaatcccagcactttgggaggccaaggtgggaggatcacctgaggtcaggcattcgagaccaacctggcaaacatggtgaaaccccatctgtactaaaaatacaaaaattagccaggtgtggtggcaagcgcctgtaattccagctattcaggaggctgagccaggagaatcgcttgaacacgagaggcggaggttgcagtgagctgagatcgcgccatttcactccagcctgggcaacagagcgagactctgtctcaaaaaaaacaaacaaaaaaaaaaagagagaaaaaatccagttcccttcttttggaaggcttccaggtggtggtgtacacttcctgccatatggtatcaggagctctgtcatgtctgatgtctctttgggtgatactaacatggagcagtgggttcagcctgatctgccattgtgaagttctccactggtctttccctaaatggttctagtgacattgatgattgttacccagatctgtgagttcagtgagggtcgcaaaatggtgaatttataatttcatgattctttctgtgtttgttattttgactttttctgtaagaaagatcttacctcattaactgcttggttaccctgaaattcagtttgtatgtgtattaaacaaggtacttggttcattctgtccctttatttataagttttcaaaataatgaatcaatgccctattaacaaataggaccagtgagagctagaagaaaattattcttgtaaaattttgaattttaacgtgtttgacgtatttcagttctttgcaatcactattacttttggtgcttaaattgtcctatcttggccaatgttcaccctttcaagttgatcgttctgcccttctcacaggcctggagtagagtttgacagttatctggttttcgtctatgacagcatgttccaggatcgttgtgcacacttcctgtccccgatctggaattgctcatttctccaagaagcagcacacgctggacactgccgtgattcctgtggattccacccccccacccctgtactctggtggcctttgcctccaggggcttcctcttcagctcctcttcagagacttcccttggactacaggaaccacgggaagtgcatgggagtttgcatcccccaaggtggcacttagccagtgaagggaaagtgcaggtgcaggagagccagctctctggcttcagtcagtacaaccttctggttcagatgagagcccagagtgtccctgtgggagcctaagccacctttgcaggacctggtctgaagtgcacccttgctcggcttctttacctccctgtcttgcttttgtcttcccgtctggaagcccgtctcacctcacggtgtgcttctgtagaacctgactggagatgccctggctactttgatgagatagagtatttagagacagtcatctgtggtcattgcttctgggtttttattgctttcaggctttttggtgggctttttaaaaagagaaaagtggctggatgcagtggctcactcctgtaatcccagcactttgggaggccaatgtgggtggatcacctggtgtcaggagttcgagaccagcctggccaacatggcaaaaccccgtctctgctgggaaaaaaaaaagtgtataaaaattagccgggtgtagtggggcgtgcctgtaatcccagctactcaggaggctgagacaggagaatcgcttgaacccaggaggcagaggttgtagtgagccaagatctcgccactgcactccagcctgggcgatagggcaagactccgtctcaaaaaaaataaaaaataaaaaaaaaaagagaaaaatatgtcattaattccgtggcatttgtaattcaaatagaagattgtaggattttaatctcacttttgtatttatctcttttcttctatcctgaaactgtctttttgtctttttaccttgcttattctgttttttaaaatggtattgtttaaaagttttttctttcctaattatttgcttctactgcatagaaataataagcagtttcgtctgttggttctgtgttcagccacagaattatcaaacaaactctcgttactctaagtaattttctgtagattattttgtttttttaggacacagttgtaccatctgtgaatatatcatttttgacccatgaattctttagtctttttttcagtttccaaatgtaaaattttaattttaattaatctgtttgtttctggtttctgccttaatttctaacttaagttagaacttaagttagattaggagaacatgatctgtatgatagttttctttgaaattcatttgcatttgctctgtgccttggctttatggtcagcttttttcatggtcggcttttgttcttgttctatatgtgcttccgagggatatgttttctctaattttgtgagctctgagttttttatatttgtatgctaaatcaggtttgttagttgtattactcaaatattctttatattcattaatattttgcttgattgatctgtcaataattttgttttatttttatagagttagtggggacaaatgcagttttgttacattagatctattgtgtagtggtgacatctgggcttttcacgtagccatcacctgggctcaggccatcctcccacctcagcctctgcagtagttggaccacaggcgcacaccaccatacccagctaattttttatatttattgtagacatggagtttctccatgttgcccaggctggtcttgaactcctgggctcaagtgatccacctgccttggcctccaaagtgctgggattacggttgtgagccactgcgcctggcctatatttacttactttatgtatctcatctaagaattcctgtatctgaagtctttaggggtgtgagtgcactcattgtttctgttgtgtctttcagtaatggtgaccttgtttcatggtgtgtttggtgatattgcttgagttcatatatgactgatcttaatcctttgtattagtcagggttctcttagagagacagaactaataggatatatatcctatatatatatgtatctcctatatatcatatatatatatataaatgatatatgtatgggagtttattaagtattaacttacatgatcacaaggtcccacaataggccgtctgcaagctgaggagcaaggagagccagcccgagtctcaaagctgaacttggagtccgatgttcgagggcaggaagcgtccagcacgggagaaagatataggctgggaggtgaggcccgttgtctccttttcacatttgtctggttgacattcgctggcagctgattagatggtgcccaccagaggaagggtgggtctgccttccgcagcccactgactcaaatgttaatctcttttggcagcatgctcacagacacacccagcatcaatactttgtatccttcaatccaatcaagttgacgctcagtattaaacatcacatcctccttttctcaactaaggttttgtgagctaattaagccctacagaaaatgaattaacaacgttttcagttttctcaaggatggaacatagcttgtacctctccagatatgtaggagagaaatcctttctcttgggatatctttagatatcttgggaaacaatagcttaaattatctccaaattccccctaacctgtggggactctgtaggccaactgaggaaggtttttgtcagagaggatttgcatttgttgtttccagaagcctgaggtgctgccagtccaggcttactttagccccgctttggggatgattcctattcagcttccccaccttgaagcgaacccaaggcttgggactcctacctgtgcactggaaagagcggttcctcagttcagcctcagtttcttaatctggaaaggggaacctgtgccatcgcatgctgttagggggagtaaagcacctgggccgtgtctggcatgtggctgtttttagtgaaagctctcttcctttctgtattcccctccaaagctcgctgttttgcttcattgtctcctatttcagggatttaatttttttaactattaagtctttttaaaaatagcctttctcctagcctttctccaacaatgactttagtctgttgcagttttcatttttatcctttccgttctttcttctgctttgactcaattgacatttttttcctatgattgatgactttcatatgattttccatgttgtagtaaatcgatttcagagaaatagttccatccgagccctggcatctttgtcctgtttatttcgagcagcagaagtcttcattgaagccagactgattcttttttccttaatttacttaagttaattaattatttatttattttagagacaatctcattctgtcacccagactggagtacagtggtgccattgtagctcactgtaaccttgaactcctgacctcaagtgatcctcctgcttcagcctctggagtcgctggaactgtatgcacgcgccaacacaccctaattttttaattttaaatttttttgtagaaacagggtctgtcaccatcttgcccaggatggtctcgttgcttgagactcctggactcaagggatccctcccaccttggcctcccaacgtgctgggattacaggcatgagccaccacacacagctgtggcatgtttaatatccatagtatggtgcttcttttaaatattgcatattttacttagtcagtttatggttgtgcattttataatttttgttattgtaaaaaaacttacaacacacgcctgtaagcccagcagtttgggaggccaagaagggcggatcatttgaggtcagaagtttgagaccagcctggccaacatggtgaaaccctgtctgtactaaaaatacaaaaattagctgggtgtgttggcgtgcgcctgtaatcccagctactcgggatgcggaggcaggagaatcacttgaactcaggaggcagaggttgcaggatggtaccactgtacttcagcctgggcaacaagagcgaaactgtgtctcctgtctcaaattaaacaaaaacaaaaaaaaaacttgcaacaaaacttttgggaatacatatttttgtgggcatgcttcatttccttagtaggtaatgtctaataaattaatagaattttttggggcttcaagtaagttttgccagattgctttctcagattacataatttttgttttcaacagggaagtttgatggtgcccatttcaaaagtggtcgctttaaactgcttgtgctcgtgggcaggggctggttatcttggctctggagccagcatcctcggtggtatagaccccactgctgtggccttcgctgttttcatgctcacctcgaagctttttttctctggcacagcccttctctgcaggacctcaaagtggccagcagtcaaggcctccacagcgggctctggggattagcaccttcactttgttgcttcttaaactcctatttgcttttatgtttctttaaagaactcaaaatgagttgcagcagtgggaggcggctccaagtcactgcacgtcttccttggtgtccctgaggtctcaagagctctgtcatctataagaattgaaatatacaataggatagttgaaaatgaagaattattgtgagaaaaacactgggcagggacaacaaaatttacctaaaaaaacaaggtggcggccatattagccctggggagtttgatttgtgggagcacagctggggtgtggtggggtgctgagcggtagaggatgggccctcggggaaggaggcgacgagtcggggcctggcgagggagcagggcctgagcagaggctgggtccccctgggaagggcgtccttccaagctccatggcctcacaggaccctctcctgggatctcgaggaagaaaatcccaggtcaagggagactggacaacgaggtacagggagcctctgtgggtttgtggatcgggggctggcccctgctcctccctgtgctgcgggttcgaggtcccagcagaggcagtgggaaggtctcaccaggctctgggcttctcagcgcatcgaggcccctcagcgcggcagaggggtccacagccacgggtgctgggctcggtgttgttgccaacgttggtgcagcaagaggtgaggaagggtccgttagcgtctctgcggcagatggtggtcctggctgtcgtgcgccacggtcatgtacgtgaagcactgttcttagctgcttgcccatccctggtgggcctgtgaggacctgacgcaagtgccgggggcatgggagctgggagggagccacgcaacgtgggcttcatgtgcactacaccccttactcgggggccctgtgtccttgtaggtggtaacgtggacctggaaagccaagcagaggggaagaaggaggtggaagcggatgacgtgatgaggagcggcccccggcctatcgtcccatacagctccatgttctgtttaagccccaccaacctgtgagtctccttgcctgctggtgtgtgtggccgcccactcacccatgcatcatgacccgtgggatctcagtagccagcgtgcactgattctgcgcacttatgtagagaaacggctctaaatcccatggcagaccccagaggcacgtgcccgtgtgacctcattctgcagaagaggacacgggcacaggaggcagcctcagcggagctggggtgagctccaggcctgggctcctcacctcctctgtggtgtgcgtgtgtctctgcacacagggacgccgtctgccctgtgtcgcaaacacacttccatccatctgccttcccatcacacctggcacctgtgttgcctgcgtgtgtgcactgtgtttatttgcatgtctatccgtgtgtccacgcctgtgcttttcatgcattcatcatccactcttcagtccagggcttccattagtccagccagtgtttctgtggcagacagcactctaggtcctgggaatagttaggaatgaacaaaacaggtgagaacccctgtccttgctaagcctgtgtgctggtgggagaggcggacgacagacacgacaaataagtaaaagacataagatgcagatagtgttaagtactaggaggaaacacaaagcaaggcatggagatgcggaccattgggtgctaaaacttagatgagaaggtcaggtggggcttctggggtgagactggagcagagcttgaggaggaggaggcagagggagaggcagacaggggtggaaccacacaagagcttgcccggccagagcaggggctgggcaggtggacgggagggcagagggcagcaaggctgcatggacgtacccctgttcgttaccgatctgcccatccccttcttctttcaccacccaaccgtctttctaccaagccctgcattaccccgctccctgcctcctccccccagtcactcttttatccaacacacatgtcttgggagcttaccctgctacgctgcggttaggagtaaagcggtaatggagacagacgtggaccctgccatgtcaggactgacagtgcagtggcaggtgaggggtggtaacccggtgtggaaatggaaacacaggaaggcactggcattctgggagcaggtgatagaaggccagggaggttttctggtggaagtgacatcttggttgaaacctgaaggatgaataagagttaaggtgaagaggggagaggggaggaactagcggagcattcacagtagcccagaagtagaagccagcagttggcacacagccaaggacagaactgggtcagaacacaaaagggtaggcagagctggctggttgttctgttgtggggttggggggttgcaccatcccggagcacactgagaagcgtgggacgtgtgcacagtgggggtactcggattgcagcccagcagggcccttttatggggagactacagatggaggccactgagtagatggtaagggtttcaggcagagagagtggtggtttgaccagggtactcatagtgttgaggtttggaagtcaggtgcgtatggaggaattttagaggcagaatctacagaatttggtgataaattagatgtggaaggggaaggagacatcgaggatgtctgactgaaacccagtttctgcctgacagtggcggaaggcactgcgttcactgagaccagcagtgctgctggggtcccgcctgcagaccctgcaaagcctggggtggctggggatgtctcatggccaggtggacttaggatctgagctgggggctagagctgagtgccagaaacccagacacaagttggagtggatgacggctgaattagaaggaaaggcaggggaagtggcaagggttgaggcagcagcaggctggcggtgggccagggatgaacagctctgtggacacaggggcaggagctagatggctgagttcccttcaaggaagagggagatgtgggcagccgcttaagatgaatggcccttgggggttcgcaggtgtgggtgagaggaagagcttagaggggctgggggcggtggacacgcctgcgaggcaggggaggcatctccagagcacagccctcgtgatgggggccgtctgccccacctgctccgtccacggctgcctcttctggtcccccacccgtagatgggcttcccagcctcctggttactgtgcactctcacgttgtggctctgccagtagcagggaggcccctgcttgttgatttcctcgctgcttcctggtgttttgactgctgaatggagcttcatcaggcctgttctggtcacccctgtgtcccccagtgtccagcacatgcctggcagggtaggtgctcagtaatgttgaacaagcgagtcgggcaaatgggactggagcaaaaggcgagcacgtggcagtgtgtggagtgtgtccccgtgcagcgtgttcacgtggagcgtgttcacatgcaccctgggagcctggacagggcacacaccccgcacaggccccagagaactttcctagggcaagagaggcctgctctccgtgagaatgttgacgctgaaattcttcctctctgagcaactccctccctgctgcccacagctgacctcttctgtgaaagggctgggtagttgatgctgttggctttggactgctgttggctgcatggacagttggtagtgaatggatgtagctgtactccagtgaagttttattcacacaaacaggtctccctatctggcctgtgagctttggtttgttgacccctgccatgaggttctgcagccttccccaccccccgtcccgggaggccctctcaggaatctcagccactgtccgtcacctggctgccaccaccaaccacagggaccattagcaaagcgaagctctggggccacagcttcctgaggcagcccagagccctttctgcgggacgggctgagcctgccctgtggcaaggggtggcgcgcccggctggggggccttgtggtgatccgtgccttccctcacaggctccgccgcttctgccactacatcgtgaccatgaggtacttcgaggtggtcattctcgtggtcatcgccttgagcagcatcgccctggctgctgaggacccagtgcgcacagactcgcccaggaacaacgtgagtggcccggatggccgggtccccgccaggctgtggcgggggagctgggtgccttcccaggggcccaaggggctggggtggggctgaggtcctgtcgtctcacagggcacccctccttcctctgtctgtgtgcctggcagtgcacgaccaaaggtctggagacaggaagacagggtgcggcagagggggcctgttcccagacggtgcttgtcagagacccccttcccagaaccgttttccacaggcttcctggctccctggctgactgctcagaggcctggaggaaaaactcggagccaccgagggcaccctggctcagatttcagcccagcctttgagaataaccttccttttggtttcaggctctgaaatacctggattacattttcactggtgtctttacctttgagatggtgataaaggtgagatatgtggctgcccttgtgaccccagtgttttgctctccctccctcatgattgagatgggaccagggcagtggttgaaccacaatttctataaactcttaagacatatggtaggtgtgtgcgtactgggtgtgtgctcagcacatgaacatgtgcacacaaagaggctttgtcgttcactgagaaaattacttcccgcgctgggagtgctccccagtgtcgtgcctgggcctccacctgctctggtttcttgaacacatgagctacatacagtctgtctccaatgtgcacatgtgggcggaggcccttcttcttaggacagcaaaggaggagggctgcatggcattggctgggggaggaggagacctgggagagagagggtgttagaagattgttggaagtgggtgctgaagacttgaatttaggagggcatttgtcttatgatagattgagtccttcactgtctgcctctaagtgttgacacgaggtcccccatatcactgactagtgtggcccttgtgtgtttatgcaggtgtgccttcagtgtggttgagtgtgcacacacctgcacgtccatgacttccgtgcagcttagggtatgtgtgagccggcatgcgtgcacacaggacagcgtgtgcatatggagcactgacagcagatgcatgaacacgttacctctgctatttcactcttgcaaaattctgtggggtgtgtgtcatcatccccattttacagatgaggaagctgacccttagcgaggttatgttaccggcctagaatcacagcagcaggagtgacagagccaggatgtgagtgaaggtctgcgtaactgcagtcctgctgctctgagcttgcctgcaggggatctgggcgagctctgagctccctggggccatgtgtacctacagcccagtgatggaggagcagatggagatggagacctcagtctcattcaggctgcagggaatttaggagcccaggcaggatctcagccggtcacaagccatgtagggatatttgggtccatggcattgaggtccaaaggcccactgaggcccttcggggtgtgacctgggccgtgtctccctactctgacagggcatgtaaaggtgtctctaaggtgcactgatgtcacaggtgtgcacataacgtgtgcactcagccacactgagccttccatggggacctagagctatattcctcccccatgactctggaaccaagccctgtagctctgcctatctttctaggtttgttttggtttggttttttgagacagggtctcactcttgtcatccaggctggagtatggtggcgtgatctcagctcactgcagtctctgtgtcctgggttcaagcaattctcatgcctcagcctctcaagtaactgggattacaggtgtgcaacaccacacccggctaatttttgtatgtttagtagagatggggtttcaccttgttgtccaggctggtcttgaactccagagctcaggtgatccacccgcctcagcctcccaaagtgctgggatttcaggcataagccaccatgtctggccatgttttattttttttcttaagagacaggatttcaccatgttgccctggctggtgtccaactcccgggcttaagcagtctgcctgcctcagcctccccaagtgctgagattacaggcatgagcctctgcacctggcctctgcctgtcttttctggactatgacgtatctaacgtgtgtttctccctcctagatgatcgacttgggactgctgcttcaccctggagcctatttccgggacttgtggaacattctggacttcattgtggtcagtggcgccctggtggcgtttgctttctcgtaagtaacgttcgctctgctctggctagggagagcccccagaatcacgatgggcgtgagggtgagggaataaggaagaggccctcttgtgggcttccctgggctgcctgtggctctgttgctgtccatgtgggactgtccctgcctgcttggggcggggctgcgtggggttaggagggcatgaggtctgtctgtggctctcaaactaggtagggccctggtgtggcctgtggccctgggaccatccccgcctgcctggaggggtgggtgctatgtggggctgggaggccctggtgcggccggtggctctgggaccgggcggcacagcctctggtgtgtccagcgtttgcctcccagggtccttggaggcaacttcaccttgacctgctctgaggcaagtctgctcctgacccagggagacctctggtgctttcgcccaaggcagaactggtggtcgccttccccttttggggcattagacgtctcctctgactcctgagccagtggcacttggccctgctgtggctggaaatggagttggcttcctcagataactgcatggagggcattgtcgggggctcagctacagctggggatgggaatacggcggggagttgtggggtgagatccagagacaaggaagacccctagtggacgacagacatgagggagggtccacatctctctgagcggctgggagggctgctcctggtgccactgactctgttctctttgtcttcctcttgctggactcggcaggagcttcgtggggtaatgccttctctcccccacacgctgcccctgacatcacagcattccagcagcccctcttgggtcatttcatctccagcctcaccccccgcccatccactttcaccccatcggggctgcatgctgccgggagccaagtccccggccaggggttcctgccatgcctctgggagcggggcggggagctgggctggagctgggcatggtcagcccttggtgaggagcttgctggtgagcaggctgtcaccagcgagggctggaggctggggccattggcctggagggcagcaagggctccgggagggaactgccacctgtggccacagcccgaggaccggggacatcgcgaggcgctcccggtgcagctcctctctggaagagcggcattctttcctctgtttcctctccactccagccccctgcagttcccactatttcctctttctgtgataaaggaatgagagctttgccaaagcatcagcttaggccttgggagtgggaacactgcagccaggggtcccccagtcaggaggaggggaaggggttgggcccatccaggcggcttcagagcaggagaaaaggagcaggccccagatggacgctcccccagaaagcctcatttactgggtgacaaaacagtatcccctccctcctgctcctgtcccctcttccctcagctggcggaggagctggtttgagagtgggtgtcgggagcactggggtgatggagacaggaggctgggttcttcccacctggaagcgtttcagggggagtttgatctgattctggagtgtagcctacagtcaggggagaagaaggggaccagggtgcctgagacgtgtagctcactctccctgctcagccccaagtgttgctggagccccaggaagagcacagggggcagggccacccctagaagcaggccttccccagggagcgtggtgggacgtggcctctgagcagggtgggaagggttccatgtgtgagtgaatcccactcagtcctgagtcctcagctcccaccctcacctcccaccaagtagagtggctttgcttctgagaacgggggccgccttaggaggaaatctctcctagacactgctggcccggcctcagtagggtcgtgggaggtccagtccccagaacctgctaattcctgcgtccctgacaggtagaggcagctgcctgggtctgtcctggctttttcttggaggggccctgattgaggccctctggttctgtacttctgcttgcttctgtgcctggaattttctttccccgacttcctgccttgccgtccctgctctgcatgagttttcctgtctgctgctttctgggtagcattgatatgtctgtctctatggctctccctccctccctccctccctccttccctccctctccccttgtttgtcttagtccaccatgcctcttgcattgcctctgtattcgtccgactttttctctttcttactctccttcccctcttctgtcttcccgctgtcggtttcacgtcagcgggaggaatgttaggacggctgaggagatctgtagggcagaggccagacaggtcccctttacctccctctagccagcccaaaaagcaaggaaaaaagcccttccagaagattctcgccctagaaacgtgcttgtgggctcccacttctgggtctgcagtcctcgtgcgggtctcttctgtcctcttaatcctggaatctggggtgggaggggtgtcaggggtgatggttcttctccttgtgcaccagatgctgctgccctagccccagctcctgtccttagatgaggcccgggccaggcagcccctgggaagagtcatggtggcctgtggcacctgcagggcaaggcctctctgctcctgggtcctccaccctggagtctgagacaaaatgcacaggggagcaggactcagaccctggggggccacgtgggagctgggcacacccatgcctcctgcctgtctgcatctgtggcttctcccttctagaggatccaaagggaaagacatcaataccatcaagtctctgagagtccttcgtgtcctgcggcccctcaagaccatcaaacggctgcccaagctcaaggttagagcctggagttggggcttgagggatgtgctgtgtgtgtgtgcgtgtgtgtgtgtgcgtgtgtgtgtgtgtatgcatgcagtgcatgagtgtgtgtgtgttcacatcacacccctgtgtgagggggttgggctcactcagctgtaagcccccattacccaagtagaccttgttcccagcagcctcctgtgagaatcctcctccttagcccagcaggaccaggcggcacagggtttttcttcagcagctgcagtgcagtgcgggaaaggctgccgggacaggtgcagggtggtggagggagatgctggaggtgaggggcttgggacattggctgctgagagggggacaggcatgggctgagcttctggataaagacagagaataaactcaaactcatagggccacgctgaaacctagtaattgtgagcttgtgctaggccctgtgcgaattgcttcatgtgcttcagctcacttaatctcccaaacctttatgcagcagattcttttactggaaattcaagccattgagacctgaggcaatggggacttagagaagaaagtttgtttagaacctgtatgtgaaggagtgggctggcaggcagctggggaaggcgtcggaggcccactgggtccagggaggagtggcacctgccctggcaccgagtggcgctgtgcagtggtcatccacagtgtgccaggctgctttgtgggagacggttgtggccccaccttcccgtcacagctagatcagagcagcctgtgaggtgtcttcccagctctgagagcagcattgtgtgcacagggaatgctgagcttccaggttgggagggacccaagagaaagcctcaggtggtgatggctgatgacagggcggcctcgggccacagagcacacgtgttcctgtcctggagcctactgctttatcctcagtttgcccaaattgcttccctgatgggcagggtgcaagtgcagggcagagcctggctgcatcctctctgcacaagcccagcacctgctggtgcagctgggtctggactcttggtcattcccgtttctgtggctgaactctgacctgtaaggtcggccctcctaggcatccagctgctgcctctagcacctcctgcccctccatccgggccaagatgcctcccctcacaagagacacagcaccagtcttgtgtgtcaaggaagctggcggtggagcctctctgtggtcaggggcctgagggccttgcagggccctggaatgcctgggggccacctgggcctcagtggtcctcaggtttccatcccgtaggtgccctgcctggtcctctctcctggctcccttcacatcctttcctgcttccggcccctccctgtggctccacctcttgtcatggctccactcctcccctcatggccccaccccccaccatggctccacccctctcatcatggcaccacccttcccctcatggccccaccctcccaccatggctccacccctttcctcatggccccacccattcccttacggccatgccctcccaccttggcttcaccccctcatcgtggctccacccctccccgtgaccctacccttccccctcatggccccactctcccaccatgattccaccccctcatcatggctccacccctcctcctgcaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggtaaactgaggcagggtgcaaggtgggacacacagccccatgatgcagacaacactgggagttcccttgggaccaggtggagctggtcacacggcgtgggagactccactgcagagcatcacggaccctgcctgagggccgaggaggggcttgcttgagaagggctagagtcaccacagaagacaggatgcatcccctccccagcaccacaccagggacccccagcacttcctcctcagcagagtcaggaaccaggcatgttctgagggacacagacatccagggagctcaaggtgcccactgggcaaggctttctctaagccctagagatcttggctgggctgtaaggtcagaggggctgcccgatggctggagctgctgtcactgtccacatgaggcctcagagcttcctgtgcccagcgctgcctccaaagtagacaggagaggggcccttggggaagagctgggggaaagctggttagctgcctgtgtggaccccgggcaaggcagtacccacagtgtcttcctgcccacgcggcagcgtcccagctgcttctgtgtgaatatcatgcagcttcctcctgtgccgtgtgactgatgggcacttggctgtttgcagctgggaatgctgcacgtgcacacgtccgccagggagcagtagcagtttggggaggtgtatctgtctggtagtggaattgccgggtcctgggtgtgcgtgtactcagccttagtagatgctgccaggcccttgtgtaaaattacactctctccagcgtagatgagagccccacatcctagctaaatcttggtgttttctttctcgcctttctgggtgtagtggtcattcaccgtggtttaattttgcacttgtgtgatgaccaatgagattgagccccctttgctagggggattggccgcttaggtgttcttttctggaagtgtctgcctgtggtcctgtgtctgctgtctgcctctttcctgtcggttactaggaatcatgtaatgttctggacaggaaccctttgtcatatgtatggatcgcagacgtcttctcctcctctgaatggtgctttctactcttttaatggtgtcttttaaaaaacaaagttcttttttctttttctttttttttttttttgagacaggatctcacacttttgcccaggctggagtgcagtgctgctattgcagcttaatgcagcctcgaactgtcaggcccaagtgatcctccctcctcaacctcctgagtagcttagacaactacaggcacgtgccaccatgcttggctaatttttaaaattttttgtggagatgaggtcttgctatgttgccaagctggtctcgagctcctgggctcaagcagtcctcttgcctcggcctcctagagtgctgggattacaggtgtgagccactgtacccaaccatagttcttgattttaatagagtccaactgatcttttttattcttttatgctgagtactctttatatcctgtttaagaaatctatcccaaggccagggatgttttcttgtgttttcttctgaaaagtgttatttttgcctttcacattaagatctgcagtttacttggaagttgatttttatgtgttacataaggtatgggttaagatacgttttctgacgatagatatccaattcacccagcatcgtttatttgaaaagatcattcttacccagtgtaatggattttttaaaaaacaaaaacaaaacagctttaggccaggcgcggtggctcacgcctgtaatcccagcactttgggaggctgaggtgggtggatcatgaggtcaggagttggagaccagcctggtcaaaatagtgaaaccctgtctctactaaaactacaaaaaattagctgggtatggtggccagcacctgtaatcccagctgctcaggaggctgaggcaggcgaatcgcttgaacctggaaggcggaggttgcagtgagccaagattgtgccactgcactccagcccgggcgacagtgtaagactctgtctcaaaaaaaaaacaaaaacagaaacaaaaaaacagctttattgagatgtaactaacacattatactgcttgttcataacaatccacttacagtgtgcaattaagtggcttttagtctatttacaggtacatgcaagcatcgccacagtcaattttagaacacattttcagcacctcaaaaaaaaagaaaaacccgcaccgtttaactatcatcccctacatccctgtcccacccctagccaactatgaatctgtttttaatctctgtaaacctctctgttctggacactttttgtaaattgaatgatacaatatgtggtcttttgtgagtagcttctttcgtgtgatgttttcaggtttgtccacgcagtggcttgtgtcagagccttgttccttgttacggctgaatatgtgttctgtgctgtgccacattttccttattctttcatttgctgatgaacattgggttgtttctaccttgtggctgttataaatgatgctgttgtatacatttatgtccacatttttgtgtgggtctgtttttgcttctcatgggtgtgtacctaaaagtggaattaatgagtgattgggtaactctgtgtttaactgtttgaggaaatgccagactgtttccaaagtggctaaagcattgtatattcccaccagcaatgcatgagggttctgaattccccatatccttgccaacacttgtggttttccatctttttagttttggtattttttaaactacagccatcatcatgggcatgaagtggtgtctcgtggtggtttttatttgcctttccctgatgatgagtggtgttgagcagcgtttcatgtgcttaatagccatttgtatatcttctttggaggagtgtctattcagatcctttacccattttttatttgggttttttttttttttttttttgagacggagtctcgctctgttgcccaggctggagtgcagtggcgcgatctcggctcactgcaggctccacctcccgggttcacgccattctcctgcctcagcctcccgagtagctgggactataggcgcccgccaccacgcccggctaattatttttgtatttttagtagagacgggggttcaccatgttagccaggatggtctccatctcctgacctcgtgatccgcccgcctcggcctcccaaagtgctgggattacaggcgtgagccaccgcgcccggccttttttatttattagaatagttatttacatattctaaatacaactcccttatcagacagaggattaggaaataagtatttttcccattctgtggatttgtctctttacgttctcggcgtcctctgagcacagaagtgtccgatttgatgcggcctgatttatctgtattttttattctgttgctcatgattttggtgtcacatctaaggctccattcccagattcgaggtcacgaagttttgcccccgttttcctctaagtgttttatagttttagctccttacacttaggtctggaatccatcatgagttaatttttgtctatggagtaaagtagggtcacattcattcttctgcatgtggacatccagttttcccagcacagtctgttggagaggccattctttccccacggaatggtttcaacactcttgataggtgggtttatttggatcttttgtctttgccctctaacctcccatgttctcattcctaggggtcagtatttggattatgagaaggaggaagtggaagctcagcccaggcagtggaagaaatacgactttcactacgacaatgtgctctgggctctgctgacgctgttcacagtgtccacgggagaaggctggcccatgtgagtgctcatcctgctctccgtagctggggcaggcagcccctgagctcggcctcccttcctccctctatccctgggctcaggcatggaagcagacccacccttgtggtgcaggtcttgagttcttagggctgtctcctttgggggttcccctgacacttgctctcctctttgcccagggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgaggtaggtggacgctctgtggagtcttgcagtggacagcgtgggcagcgccatcaggcttccctcctgcacacaaatcactcacagctgggtcagctttggctgccaccgtctgccaacacaggggcaggtcctcctttctcctgcagagggaccggatttggctggttgaggcctgcttggagaaggtctgggctgcttcaatttgtcttctgttgtcagggctccctgtgaggcctggcgagacagggctgggtgcagtagatgccgtcgggtaggttttctgcttctgagtctctgtgctcctttctccccttacagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaaggtgtgtggggctcagcgcagaggggcagctggcgctgctagggattgggatctaaccctgaggctgagtggagagtcagccttcttcctccctgcatgagccaaagcagtagtggccttgcatcctggccagcatgggatgcctgtggaatcctgtttccctttgttgtctgtgggctgggacagtggggaggttctgggaggactcggggagagcaggaaggggtgtcccaggcctaggcaggcatcgagttctgtctgcccgctttgcttggtcatagtggtcccagatggggtgtcttggggctgccaaacccatggccaacagtgcctattccccgggcagttctatgatgcaccctatgagtacgagctgatgctgaaatgcctgaacatcgtgttcacatccatgttctccatggaatgcgtgctgaagatcatcgcctttggggtgctggtacgtgctttggtccctgctttgccttttgacaacctatattctggttccccatctgtagggcgacctttgggggctcacaatttggagctgggaattctccgagtacccagagtatatgtaatgctacaggggccctggggaaggggctgttctgagactcttggctacataagctctgcccccagcctaggtcctgggagggaggcagggctgggttcttcctctttggacacatggctcttagtcctgcctctgcccaggcccagaggtatctgtgtccctggctttgacatctgcttacctctggccttgtgctgtgccccctggggtggcctgtctgccctgtgctcagggtctatcaccctcaccgctttcttaatcagggccaccacctatatatacctctttgccaacagagccctcatcagccgctggcactaactgctcttctttttctctagaactatttcagagatgcctggaatgtctttgactttgtcactgtgttgggaagtattactgatattttagtaacagagattgcggtaagtagcatttctgtccctccttcagggtccccaggtggtttccttctagagcctgctcccctcagtgcatctccaggccctgtgttagcctcttcctgggttccgcagaaccccctggacatgtggaggcttcgctccaggggtggagtttagggattgggtgttacctcagcagatgttctttcttgaataagaaagtggttctcaaagatcttttgggctgctggcctgagagttacctggagctccatggtaacaactaatcaagaagatgtgaatcttaaatttgtatctgtataatatgtatctaacaaggtggtatcaaaaatatataaactgaaaccagtaaggatttatatttcaaaatattgccccccaccgtctctctatctctctctatatatatctggaaatactcattcttaccaaacatatgtggattatgtcttaaaattgaccagtgctgggatataaacttgtctcaacaaatttcaaagcatctgaatcataaagcaacattctttgagtacaacacattacactggaaatcaatggcagaaaatctcatttgtttggtcttaggttgaattctcgagaagcagacgcagacacgagcactcatgtgaaatttatttcttaagttatgttcccagtagaaaccagcagaggggcatggggaaatgggtgggaagagaaggaccagaaatcctgcgtcccaagccaagtcctggtgggtcagtgtgggtcatctcccaagggacttctggcagcagcgtaggtcgcacctcagagctatccctgctggaaagggagctgcaacgtgtttgcctctgcaccctccgcacggcattaggctgagggctgcacctggggtgtcaattctcagatgcttccagctccctgagtgtgccacgagtgctgcacccaagctgttagggctgaagggacgtctgacaccatcagaggagaacctgctggagcaccaggctccttcctgttctgcccacacttcacattgggttcactgtgctcattctttaggatggtgctggtcatggtctctgggagacagagcggagctccgtctgctgtgctggtccaagcagagctggtgttcatcatcccgttccccccaccctttctagagcccctgagctgatgttcatcatcccgtccccaccaccctttctagagcccctgtcctgtggccagccttctgctgcactggttgctggcctggtgggatgacccagaccctcagccctgcgcatcccaagtccctacttgttgccgttctttttccaaccctggctgccgtggtaatccagtcgcagtgaagactgcgcacaggagcgtgttcataggagcatggagaaaggcccagtgaagcccctgattcccagaattatgcagtggcagctctgcccttcacagtaatgagggtcagatgatctggctggcatggaaactctttgtgatgcctgctggccttctggcacgagcagccccaagtgaccaggtggccaccatggctttggtgttgtgtggtagaagccttctccacctgtttgaaccagggcctctagatttgccagacctaaaattggggaagatgagcgcagagttcatactgggtttctggagcgatggtgagacaggccccttcttctttcaccatttcctccatccatacattttactgattgggcacccagtaccatcgattggccgttggttcatcttgaaatatggcaccccaaccccatgaagtgtatcaccaagccggcattttatctctgcctttaaggtcagggcagcgtctcctaagtggtgttgcgttagatgatccagtggaccccgcggtcacctggctcacatgcatcccctgcgtgtgctccaagctgatgttatatggaatcctgtgttggtaaatctctgagatgttagtgccggcacggtactgcacaaggaaaggcaaacccacacctgggatgtgggtggatcccagatgagacaaatcactgccctttccaggagagggtgttctgatataatcagcttaccactaggtggctggttgacagccccaaggcatggcaccagatggaagcccagtgttgctgtctgttcattcccggtagataatcgtcagtggtcatgactggatcatgctgctgagaggctcttggccacgatggtcaccctatccagaggtctgctgtgtggacactggggctggtgaggacagaggctagccaatatctgttggtcgacttatcccagtgcttggtttttagtgccccatggtgagcattggtttgcaaaacaaaggcctgtaccccatgcctgttcccaaggcccatctgtctgcctctcacctagaccttgttccctccaggatcctgaccagccgtttgtgcctgcctaggaccctgttatcctcagcacaggcaacttgttttcccccccacacagagctgaccagataccctgcccagggctctgctccacctctgtctttcaggctgttcctatgtgaggctgtagtgaggcctgcaccagtataccaagcaacccatccacaaatcaggtctgcgtttccccctaagttgtagtgaatccccatgaagtgatggcgggagtgaggtgaggacgtcattggtcaacagaggtgcgtgtcatgggggattgggccacatgttgtgtgctgtgtcctctagacatgcttgggttcggtcgtagaggtaccccttccattgttcactgggcctgtggtgggtctgacagcacatcactatggggagatgctttggtgtcatagacagcgatgtctcttggtgacacacacagctgccaccagggccaggaagtaggttggcccctctcattatgcttccgttctgtagatggcatggcctgctcccaaatgctgggtgtctgcactgacttctctgtggaggctttcccaggactttacccagtatccttacctaccacatacacatcaaggaccctgggggttgctgggttttgtggcccaagtggcagggccactgctatcacatcctgggtctgttggagacctcacttgtgctctgaaacctctcaagcatggcagcgtcttgagtcacagcagtatttcctaagtggcctatgccatctccaaaacgcaaagcagcctacccgcagtagaagtgtgaggtgcaatcactaacttgtctcttaccttggagtccttgtcctggcatagcccagaccactggacccctaaaaacttcactgacgtggaaggtccatgaatccttgtaagatttatcacctgtgctctggagtgcgtcagggcatctgatctaagtaacataacatcatcagtgtggtggaccagtgtggtgttctgaagaatgtcttggcaggcacagtggccacacctgtgatctcagggctttgggaggccaaggcagggaacgtcttgggcaggcacagtggccacacctgtgatctcagggatttgggaggccaaggtagaaagatcacttcagcctaggagttggagactagcctaggcaagacggcgagaccctgtctctgtaaaaaatttaaaaatttagccaggcatagtggcacacgcccgtagtcccagctacccaggaggctgaggcaggagaatcacttgagcccaggaagtcaaggctgcagtgagctatgatcgcaccactgcactccagcctgggccacaaagtgagtccctgtctctaaaaaataaaaataagaattccaaatgattaagagtacctttggaccatgttgtgacatagggtcagactgtgaatgtctgctgtggatacaaactgcttctgaccctgcttagcagtgactgctgaagagtgtgctcaccaggttggcacctgtgtgccaagtcccagaggctgagtagatctgttctattaaagataccaaatctcccacagcagtgggtactgagcctgggttatctggggagtagtccagtgtcatccattgtgatccagttttcttgcacagtccatactggtgaattaaatgggaatgaggtgtagaccaaccacccctttatcttttaattattcgaggtggcactaacctctccattccatactggatgcagtgttataatgtaccgttttggctggggggtgtcggtgttgaggactttcctattgttatgtctacttcacatgtcgaggagccagtgtggtgggttcggccagttagttaggactagccaaatgaacaccagctgtgcctgggcacacgagaccactgagagatgggcctgggccagggattcattggtgtcctggcccctgcgcacactctgagatggagccgcaatctcattttagttccttggtatcaatgttatcttggaccttgtatccaacagccttcaaaacctccgggtattctttctccagtgtgcaatttctcaagtaaacgaaccagatctccttggggaggggcagagaaatggttgctgtctggatccagtgtgcaatttctcaagtaaacgagcccgatctccttggggagggcagagaaatggctgctgtctggactccttcttgtgttgtaggattcttctgcaagggggcccagtctctcctctaagctgtggaccctggatctgaaaactgactggttgagagactcgggagggagcatgtttgtccatggtggtggctgttatcagccttctgctcacttactttcattcttttgaattctatatttacatatgttaatctcaagcagcatccttgttggcgctgcccctctgtcctgcctctaggaatgccatggccgattagccgaagcagcatccttgttggcaatgcccctttgtcctgccaatgccatggctgattagccaccactgtggacctttgcaggtcagggctcttggttgccattgaggcctcgctgcccactgtggtggttccaggcaaccagccatggaagggagccagcctcatgtgattgtgtgctgccatggagcctctgcagctccagagccttctcttcttcccaaaggaatccctgctccatgacagcatctcctcccgtcaaccctggcctgcagaagagaaccaccagtggccttgtgcgtgatgccagtgccctcctcccaaaacgctctgagaagctggttggctcgtgggcacttggatcgtacatgataggttctttctagcatgcctacctctctgagccttttggtcctatgctcagcatctgccaaggcagttctggcaccctcacctcatttaatgtgggctatgaggttttccaagctcctgggagtcatcccagcagcctgttagcacctgcttcaggtgccctcgccagggtattggatcctgagtcatgggagaaagctcccctacattaaaaatagttttttatcctgcctgtcttccagccatcctcatccagtccctcccaccttgctcctgccacacatacccgttatatcacacagcccttcactgggcagcctttttttctcactcagcaggaccaccgcttcccaagtcaggctgtatgaaaactcgagttgtgggtctagtggccggcattggaagtgaggtggaacttggggagggtgagtaccatcgtggaaagcatccacctcagctgagactcctgcaggtattcaggcaagacaaagtgaggtcctgcagcagggagggggacgctcctgcaggcccaggcagtcccggggcatctgagagctctgtgttgggggcatgcccacactggtgttcctcctctgcgtggcagagcctgcccttcctttctgggtgctgacgttggagcatgagagacttgtggagtcctctctagagccctggtcctcccttgagtcccaggctggtcagcacaatccgaaacacagaccacatttgggttatgcttggagttgctaattgacaacttgtaatgttttcttccccagagtaattggtggcacttagccatggttcaccagctctaccatccttacagcgcccattcctgacagcctgtggatgctaatgatatcttgcggtatcgttattgcacccctttcaaccctttacagatttgcccaagatgaaggtttcagcagttttaatgctacagcacaccaggagttaccgtcacctcacttaccacccaccaacagaggagaatctgtccagtgagccactccccaaggtctccatccttagagtcggcttccaaggaaccacccctggtgtcacctgtctttggatcagaacgtgtgatccaaatgtgatttactggaatcacagtttccaggaatagttggtgaggatgggggcagttggataaggaagagatccagtttcaatcaattccatgtaatttgggctccttcctgcaggggagctctgagggtagtgtggatgccacatcagagttgtcccagtgaggggcaagagagtgcagcatgggctccacctgcaaagcaggttctggcagcctgtgggaatccctgcatcaagagacccaagagggcggggcacgctggctcacgcctgtactcccagaactttgggaggctgaggtgggagcatcgcttgaacccaggagttcgaggctgcagtgagttatgattgtaccactgcactccagtctgggcaacagagcaaaacgctaaaaaaataagagagagagagagagaggcagggaggcaggaggagagagacagagggggaaggagagagacaagtgctgctgtggggcgtgaaagtgcattgggagccagtgtggacagaagcagagcgatcacagggcctgtgtggctgagacactaacagtaccttctccacttttaaggaaatgaacttctgaataagtcatgggtaaaagatgaaatgatggaaattagaaaatataaataacagaaaaacaatgaaaatactgtatattaaagctcatgagataacagctgaagcagtactcagaaagaaatttacagccttaatgtttatattagaaaaagaaaacggtgtaaaaattaatgagtttagcatctaactttaaaagttagaaaaagaacaacagaataagctcaataaagtagaagaaaagtataagaatagaaattaagaaagtggaaaacaaagactagagagaatcaataaagtctaaacttagttctttaaagacttaaaaattgacacacttctggcaagattaatcaaagaaaaataagaaggtaaaatacacgatgtaaggcaggggagaggggtcatgatggtaggtacaggagagagtaacgtgaataacgtgaaggagaatattgtgaatagtttatgccagtacgtttgaaaacctaggtaagtgaacacattactagaaaaatataaatgactgaatgtgacaaaagaagagagaaaaaccctaaatggttctttattaaagcattaaagaagttgagtcaataaacaatcttcctataaagaaaacaccagattctagtggtcttatacattaggtttctacttaaaatataaggaaagatcattccactcttaaacagatttttctagagaacagaaaaagagtgaacattctctaactaactagactagtataatgttgacattaaaatttttttaaaagaagagaaggctgggtgcaatggcccaggcctataatcctagcactttgggaggctgaggtgggcagatcacctgaggtcagaagttcgagacgagtggataacattgtgaagccccgtctttactaaaaatacaaaagttagccaggcatgatggcgcacgcctgtaattctagctacttgggaggctgaggcacaagaatcgcttgaacccaggaggtggaggtcacagggagccaagattgcgccactgcattctagcctgggcaacagagtaagactctttcaaaacatataaataaccagaactctggcactgctggtgggcgtgccagccagcacagcatctgggagggctcagcagcccctcgaaagttggacatgtgcatacaactcagcaactgtactcctaggcaggtgtcccagagggtgcctgcacagataacccccagaggcattttcacacaagtgttcctggcaccagcgttctgccgaccaaacagaggcatctgagtgcccatcggtaacagaatgtgccagttgttagggtctctgctaacgtagtgaaaatacgcaaatgatgtgaaattgaaacacagctttggggggtttctgtgtgtgcacccctttccagtgacatcagcacagtgtggatgcttctcagaaacagtttttggtcagagcataggtgtgcgcaagtcaaagaagcctgcgggcagcctgatcccacaacaaaggccagggacaggcaaacatagaatgcatttccagagtttctggtaaagctgaaaagacaagccatgattaacaagaagggaaggtagtggctgcatctgcagaggaggaagggagacccgagacggcttcggaagtgatggtgatgtgccgttcgtaaagctgggtgatgaatatatatagatacttggttttacttttctttaaaatatttatgcgtaatcttttatgtgatatgctttacgatttaaaaaagttaatgatctgagtaatccaagcaaaaaagctgaaacctgccatttaatcagaaaaatcagaaaagttgagtccccctagcactggtgttgtgtttcccagtggctgcctcctccctgtgcgtctcgcccggaagcatttagtcccagtgcgctttccgagaggcacaggtgggctgcattgctgattcctaagggcctcctccttggaaacagaaatctttattcatcaaatacagtgatggaaacattgagctcccagctgtaaggacacagcttggtggggaggggtggtttctgcgtgtgtgtgcctcctttccaagaggggcgggaactgctgactgctgagagggcacaaagtggagggtgcctggctgacgtcagagatgtgcagagagccccagtgcccagccgggctctagggaaacctccccacaccccaaagaggccctggtgtagggcagaggccttgatacaaggcagattcctgctgcagtgcaggcagccagactgacccacactccgtccctcagctgcgagacagtcgaggccgggctgtttgtggtcgtgtcagaccctggctcaagcaagccctccttggcagcccctgccaaccctggacacccagcaggttgggggcctgagagctgctggttggaaagctcagctgtcccctggccactcttgctcctggagcccaggtcatctcctgttctgcctggaggagaaaagatgaagggaaagccatcgtgtggactggtggtgctttgttttgtttgtgtgtctgtttttcatttggagccacttcatatgtttactttgtgaatgcacttttttttcttaggcaaaaatatgagtgtcagttcccatccccaacttaaaaatcaaaatagagttttagcaagggcacccagagagagggctccaagcaagcatgaaactgacattgatttctttgcctggaaataaaaataaataaataagtgtctgtgagtcatctttggatttgcattacaaacaagaatgcaaatgaatgccaccttgtctgcataacctacagacttcaaaaatatgttttgatctgatatattttaagaaaaataatgcagtttaccaaaatcctaattttctagttaagtaatcagagtttgagtttttgcttgtgttgatgactcattttctcttttgttttctgtttttgttcttgatttaccttaacctacctgctgactcacgccatccaaccaacatacaatgcgaaaacccatgtctccgtctgtatgttgtgcacctgctgctcaaacctccccaatttgtaaataatatgcaaatatccatccatgaaaacatcacatgtaggaaacggttggtttcacgactctgaacggttcttgcaagtccttgctttgctcgctctgctcctctcctgctctctggttcctgggactccagcccactgccctctaggcgtgtggttggatgcggctgcatccactcacctctggcctcctggacttgctccctcggctctgggcattcagcagggcttctgagggccctcctggcagcgatttgattctgggaactggccgtgggcagggcttccctgagacctgcccaaggagagggaggtggggtttctggagtgggtaagtgtctagggtagtttttcctgttgggactggctcagatttggggaggctttgcaggacatgagtttgtccctgatccctgcgagtccatggttcctgttgcgcagccatctcccacctgctgtgtccccatcaagccaatcaagaaggccccgctttgcccaggtggcctctgcagactcccctgtagcttccgtccttcctggactgaccgtgccttggagtgggcagggtcaggcctggggttcagggctcgggggcagggcttacagtctttgtcttcatgattcaggagggttcttgtagggctgagtagaagaagggggctctgcccctagaggcagtggagccgaagctcccccattcgcatgtcactgaattgtgtatgtgctcggtcagcaagctcatttggagtgcaggtccaaccggagcttcctgctgggtcttcaggaattttagagcaaagatatttggtaactgacccaactttagctgtgactgtggaaattaatataaagtagaagatatttgagagtcgtgtaaaagtgaatgtttgtgatacagcgattcacaattggagcagaagagctagcgttttgagaaaataccatttaatgctgcagaaacacccaggcaatgtcatctgcacgcatccagctcgtgccagtcaggcctctgctcagcgtcacctcctcagagagcccttccccacattgtctgtcccctgtcctctttctccaccacacatccacacctgacatgttactcatgcacatgcatgtctctttcccgtcttcaattgtcagtctcattagaatgaaagggagccacagagcagtttttctgcacctgctgggccttgtcctctggtgtggtagctggcccacatcggggcccacagatcggggtggggtgcccagctgacactcgggacaagccctcacttccctgtgactctggccagaggccgtggtggtcttggatacaggggatgctggtcttggtccagagtcagtgggtcactgtcatggcacggtgtcctgcagtgctaagagcaattttaaatcccttttctcaagtactcctcacctcctggactgggtgtccccgtgtttctttgtggatgagaaagctgaggattgaagggttagggaccgttgtcccatcaaggtgagtcagccaccatgttgagggcacaatgctgtgcctttggggtgccacagaccttttccaactcaggtagaagtaaggaagggcctggccttgaagtaggtgtggctgcaacagaagccatggactcagtgaggttggggcaggctgtgtctgcctccgaggggctggcggaggccagaggtgatggtgcaggtgcacggcgtggcgctgcgtgtgcttctgtcccttgctctcctgcatgcagctggcatggtgctcggcctgccacgctgtgctcgaacatctgtggctgccgtcaccgtctgtcttcacagctctccagggcgcccgtctcctgcccccagcctctcctgagtacccacaggagccccgagagaagccaggaggaaggggggagtgtgggtctccacaaaaacagaaagtgatggtggctgaggttggcattcatgcattaagtaatttggacaaactgttactctccacgcacctctcgcctgccctgttgtcttccagtccttccttcttacctggcagcctttattttccccagtgtcttcagggaatcttgtctgtgccactgcctgactgtgctttgagccagtgggtgctgtgttgccccagtccctgcccctccagaccccctgagcacaaggtttcagagtgggagcctccaacccccggctctgcttcatcatcttacataagggtctcttgacacgggactgcggccctccacccctgcacccatgtttctaagatggctggcttctctgtgggtcctcgtggcccagagttcttggccatcttgtctaccgtggagattttctttccctggcacaagcagattacggagctacaggtacacttgtgctgccctctggggtcacaccctgaggtctactgctgccgccttgctgatttggatcatagcccgtccttgtgcccactggccatggatatcattcaaaaccagtcctgctcccacagttgcagcatcccgcctgagagccagtacctcgagttgaatcctcagccaccctgcccctgccagtggaagtggcagacctaggcagaggtgtcctcagtacgggttgggccactgtccctggaaggaagagtgaggcccacccctccactgacacctcattcccacctaacggtagccctggagagtcgggatgctctgccaggccctcaccgcctctgcgcctgcacgtgctcctgctgctgctgtctcatttgacatctgtgttctctttatttgatgactgaatctgacaacacgaacgtgtctctgagcctgagctgcttgcatattttaaaatgctgcagtggcaggaagctgctctcaggctgtgtgtgggcacctgacctctaggtagacagagggcagaaagcctcctgggtccacaagcacccccatctgtgcacggacacctccccagagcctgcttccctgaaagggatgtgccagtacagtaattcaagtgccctggggccacgtggaggctttactgccaggtaatctgtggagtcccaggtttatccatttatcattgtgcttgattttgagccccttggatgagggagctccactagacagcctgggctctctagagcagaggcctgtttgaccgtgaattgcagaggtggcttccgtggtgtgagcagcagaacacctgtaccttccataacttgtctgcacacgcctggagcagcctcagaggaagtgtttgcccctctgccaggtcccagcgagggtcccaggcaagcgagggctttgctgactgagccagggaggaaagggcatagccgtgaagcctgggcgggggtcccttccggggtgctgggtggagaagcagtcatgcccagcacgtggccagcttgaccgtgtcctgcaagaggtggtcactgctggaggcccagccacaggtgatctcccagctcacctggcagcagagagatgcctgggagaacttttctttctgttgctcacggttgggggtggggaggggccttagagccaaggaggttttctctgatttgctgcatgagaagtgatttgcaaggacaagctttacttctggaagattttctggtggccgattgctgcttagactgtgaagcagagacctttgattttaatctttttaaccacttttctttggggccacagggatgtgggaagaggttgtagggtggcagcagcttgcctgcgctttcggggcttctgaaggtcagagaacaattcctcttctctgcagaacaatttcatcaacctcagcttcctccgcctctttcgagctgcgcggctgatcaagctgctccgccagggctacaccatccgcatcctgctgtggacctttgtccagtccttcaaggtgggccaggcggggggcctccatgctttctgtccccttcctccgtcttgcttcccctgcccccaccacagtggcccctcctttgggaggctgggagagggtatggcatgcaggtttcgtggttgtatgcattgtcctgttgtcatttataaagacgttttaagtcatctgtaggttcccttggtcatgctcacaagaaccctgaggtgggtttcatgactccgagttagagataaagaaactggggcatcacttggtggaggggcttggtggccagtgggatggagcttgagtaggctgaggtctgtgtgacctcaaaggcccagccaccgtagcaggaggcctgggcgtggtggctgggaggtgcctgtagctgaccggcccctgtctccgcaggccctgccctacgtgtgtctgctcattgccatgctgttcttcatctacgccatcatcggcatgcaggtgggtgctcccctttgggacagagcgtggttccggcctcccgtgccctggagcagaggggcactgatcatgattgtcaaatcatcgtcataatcagttgatccttagtgaacattctctgtgagccagatcctgctttgagcacttgctgaacttacgtaatcctcttttcttactcttttttttttttttgagacagagtctggctttgtcaccccggctggagtgcaatggtgtgatcttggctcactgcaacctctgcctgctaggttcaagcgattctcctgcttcagcctcccaagtagctgggattatagatgtgtgccaccacgcccggctaatttttgtatttttagtagagacagggtttcaccatgttggccaggctggtattgaactcctgacctcaagtgatccacctgccttggcctcccaaagtgctgggattacaggtgtgagccaccgcgcctggcctaaacttacgtaaccctcagaaagactgttttgcggaggaggacatggaggcaccacaagattgggctgcttgcccagggccatcctggtgtggggcagctctggccctcggcccattgccacctcaacaggtggatgcaccgtggtgttcttgagggctgcatgggctcccgcccagtgatggtagggtgtcggggcacaggtcagaatgggtgctggctgtgtggtggaggcgcgttggagcacagctgtgtttgccgagtggcttgcacagtggcggtcggttatcctgttagtctggcagccgcgctgaaggacaggcctgacccgcggcgggggttacatgctactggggaaaactgcctgagaatgtgagcaggagcgcatcggatccttgcgctgggcaaacttggcttgcataatttagattttctttattttagaaagaacacattgtcagctatttgggaaaaagcatttaaaaaaacataaagcagtgtcccagttataaatctttggcatctgaccacttttccaacagcagggacggaagagggacccgagtgttaatttgttatcgaaggtgccggtgtttcaaaggttcacggaaaactgatttctaaactctatttcagggattgaagagttctcttgctttaaaatttgcagagatctgatgctgtttaaataaatacatctttttttcctgctttggtctgtggatgtacaagagcacatacgttactgatctttgtggatgtgtcatagttcataaatttgcagccagattccagattttgggctgagtacaattactgacccatttgcatttcttactgtggaaaagtcagttaaaatggctaaaaagcccgttgtactattgcatatgttttaagaagacattttcccatgatctgtcagacctgttaccaacataatgcctgctttggagtcgctgatgatcccacttgaaaacacttcctgtgttacgtgtggcagaggcctcacaaacttagctcggggccgttcttgtgagtgtttcggacttgcatctgtggacaggttcagagctggagccggcacatgtgtagctacggagagggcgtctatactgggaatgcacactggcctctcccgggtgggagttctctggtgtggggcagtcgcccatctcacgtggggtccttgtacggctcgcacgccctctctggctcggtccacctggcgcggctcctgcagacccagcagggtccgtgccattgctcttctccattgcaggtgtttgggaatattgccctggatgatgacaccagcatcaaccgccacaacaacttccggacgtttttgcaagccctgatgctgctgttcaggtgtgttgttcggtcagcccaggccaatgtctgctcttccgtcgggggctgctttactcaggatgaagaaggctgggtgtcaaccgtggagaccacccacttctaattccccgaccccactggcttcccctcagcaggcctttctggttcttcccctctctctgctcctcttttccaaaggctcttgatatctgccccagtctcagaacaggctgaagggaagccctgagggagatcatcctgggagccctgggccaggccggcctctgctgcctcgtctgtgctccctggcgacagcttgggagcctccggtgaggctccaggcagaggtctgggaggacagaggtgcctagcaggggctctcttgaagtgcgggcctccagctttccacctgcgcccttgttgattacagggattggtgggatcgagggcagtagggcaacagggggaactgaccagcagagtttgtagctactcagtggcccaaggaacccaactgaccagaactgccgatctgaacacacctttattttccaccatctctcatgggagctgccgttccctgggctcctggatccagccaagccaagtaacaggcagaacctggaggggccaagaggccatggcacaagcttcggggccttctgagatctcctggtggagatgtgccaggagaggcctcagcatcagctgctgttcctgggcgcggaacaggagctatgggccatcctggtttgagagtgaacttgggagcagaagggaggtgggtgaacatgttttcctgcctcctgagtctcccacagtttatcactcacgagcctaggacagaaggaaggagctcttttagggatttgccatttcagtccatgtgtgcaaatgcactgggctgctgtacagcccaccctgcctgcagatgcgcgctggggcgagctcagacccagacctgctttgctgagctgcctggagagacctcttagactcttgtttctttgcataacataagcaagcacccttaggctgacactgtccccagatgatgttgtttggctgggctttagctgctgcgttaattttatctcatcatttattactattctgcctcatgccgcggaagacttaaggcaaacctatgaagtcagccttagttttgaggcctttggtctcacagctttctgtttctccctgaacttcgtgttccctgggaacacccttatcagtcaggcccagcacaggttgaagcagcagccctgcaggaacccccctgcctccggctgtcatcagtgaggagtgggcccagcttacgcctggggctgcgcacacagacacacggaggtggggacccaggcctctgacccacttgtaccctgcaagcccccggtgctggctgtgtccaggaacagactccgtgcaggagcatccagggtggctgctcagggcagggtgctcttgaggtgttcaaggaccagcagaggccagggtgcttggagtggactgagctggaaccgagatgggggtgaagtcagggaaagagtgggcagcaggtcccacagtgctatgggcagtcatgtggattttggcatttctgatgagcgaggcaagtcatcggagggttttgagaggaggaagaatgtgatctgacctgtgcttagtggacctgcttcctgccgtgtagggcagagtgagaagataggctcagaagcttccatagcacagggcaggtcatggtcgcttggcctaggacagtgaggagtggtgagagcctggctgtgttttgaaggcagatgatctgatgaacaggatatggagagagagaggaggcaaagatgacccccacagttttggttggagcagctggaaggagagtcaccatttctggaaatgaagaccaagatggcgtgtgtctgggaggaggtcaggagtacaactggggcctgtggtgtccacaaagaagtgctcgccctggcgctggcccctggtgccgtagataatttttagtaagcagtggtttcccaattaatgctcagtttggaaatctagtgccagaagtttcctttgaagaaacagcatctgtgacccaggcctggcacatgtgtgagctgtctgtgggaaggagcccaaaggagtgggcacgcttggtagccccacagggctcgggctccctcaagggcctctgtgggcctcacaactctgcccttcttctcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctggtgagtcctgggcactgtgcccctcccagtgccacgtcttgtctcggtacagctcaggcttctcccacatctcctgctgatccctgactctgatccaggccatgtcagaagctgagtccatgctgatggcccttgtttccccagagatggcgactttgttagccagagaaagggccgacatggtaacgggctcctgtgggcccttccttgacatccgtggaaaagggttacatttccaggggcaactgttccttaacttccagcttctagaaggtcatccactgtggtgatgggatgtgaaggaacagcatcccagccagtgtacggggaaagcagctggactgggtggggaggtcggcagggcaggccccagaggtgtggattttatttcacatccatggaagcctctgggggcctcacagcatctgcttgacgttttacagcttggctctggcttctgtgtgagtagtgaggacgtggctgcagagcgagtgaggagacgactgggggcaacagtggcctggagaaaggagaggcaagggagtgaggtgggattaggctgcattttaaaagtagagctggcacgattgatgatgagagatgggcatgcgaagaggaaaaagcaggctgcatcctggggttttctggggccacagggtgagcagttcttctgagatgggagtactggggagctgagattagtttagggttggaggcagcagagatgcccagcgacctctgggctggatggaaacgagttgtcgttagtgttcggtgtgttcgtggggctgcatgctatttgctggatccctgttaatgcgaagcttagtgcagtgacctgcgtccaaagcagtgcctgagtgcctgttagacatacagattcccaggccactcccgagactgcatcagggtgtcttggagatggatccaggaatctgagttttaacaagctctcaaggtgactctgtgtgtgttgaactttggtgagcactgacgtaggggaagaacagtgttcagaagaaggctgaagactctaccccaagggcattgaggaggcagaaaggagcactagatccagaaactgaggtggagcagtccaggaggcaggtggagaaccaggagtgggcggagagaggaagtaaccagccatgcaccatattgacggaaggtgatgcaagatgatgaccaagaattgttaactgggccgggcgtggtggctcacacctgtaatcccagcactttgggaagcccaggcggacagatcacctaaggccaggagctcaagaccagcctggccaacgtggtgaaaccccatctctactaaaaatacaaaaattagctagacgtggtggcaggtacctgtaatcccagccacctggggagctgaggcaagagaatcgcttgaacctgggaggtggaggctgcagtgagccgagatcgcgccattgtactccagcctgggcaacagagccagactccatctcaaaaaaaaaaaaaaaaaaaaaaagagggaggctgagacaggagactcgctagaacccgggaggtggaggttgcagtgagccaaaattgcgccactatactccagcctgggcaacagagcaagactctgtctcaaaaaaaaaaaaaaaaaatgttgtttattggatgtggaaaggcagaggccgttagcacccttggcacatcgttcctccgtcagcgtagtgggagtgaaggccttgttgccacaagtttgagagccggtaagaggagaggagcacagccgggacagagatgctcttgacagtgagcagcactgaggaaacacctcaagcctgtggccctgactccaaggaggaacagctggcatggctgtgcttttctctagccacattcactcctcagtacaagggtagaaaagtggattatccagattcgggatttcccagacaagtgcaaggagggagagaagggtgtgtataagagtgtggttattgtgctggacgtgggatcaaagctggggacagaggagggtgaggggcaatgccactggattggaggttctcgtgaggacatgttttgggatgcaggtatttgaaaaagggagccggaaaagtaggcgatgtgagcagagtgggatgtgtgaggtggagactcgggaggcagtgagtgatgccatcggtaaacatcattgccgtcattacattatcattgcaagatcattacattaacattagcatgatcactgttgataagcatgtttagtgtgatttgtggaacaaggagatgagctgatgggtgagaaggttcaggaagggagagggcaggcagcggtcgtcccatctctgtggatcttaaaagcaacaagaatgataacaagaatagaagtggagacaaaaacagcaagccaggtgctaagtttttcatgaaggaaggggaaacttaatagatgatgtgagccccagagaacaggtttttaaagaagagaccagaggggacatccatcctcttagatgtttgagccagagcaagaacaagtggagagcactcaggggagatggagatataaggacttgtgctgatggcggactgtgagctttgcagggtgcagtaggaggttgaggtggttgggaatgatgtgcacttgagacaggtgagcttacacttagatagagaaatacagaagaacctacaaaactgtgtttcactacttgctagaaaccaagggaaggatttccatgtttgagtcatctcctgatccctccgaagaccccttgtgggcagcagggagggtgggctttttggagaatcactttcctgaggcattggtctctatactgttcaaagacatctggtgctgtaagaaccagcacacctgtgggcacaaagccaaacctactagcctgaccttaccatgcacctggccgcagagatggggttccacagaaagccacattcatgataccacaccacgtacagggccagcactcactagacatgtccaggatgagtcgaggaatccttgggtttagctatcactcctgtgcagagaagagggtatttcgtggccactgtcctttgttcttgtccccatggacctcagtcatggttcttggctaaccctggtgtctccttactgaaactgtaatcctaatccttctggcacttccctcacagattggacatgctgggcaactcatgctttgaaacacttggatgtggtttggtctgatagagaagtgacatggaaaaaatgggactgtgaatttgggatgggtggcaggacttcgttaggttgggatttggttccattaattggaatagagggtgctgatggaagaatagggaatgaggttgttcatgacagcctgctgataatcactgagtcaggcactatgcagggtcttatgaatacattaagtattttagtctctgtgacagtcctgagattggtattattattattacaatgaagaaatggaggtctagagatgttaaatatcttagcctgagtttagaacctaagcttttgaaatggacaaattcctagaaagacacaaattatcataactgactgaattaagtagaaaatatgaatagacctgtaacgagtaagaagattgaatcagtaatcgaaaacttcccaataaagagaagcccaaaaccatataatggcaaagggacactctttgctgggaaaacgggacatccacatacaaaagagtggagttggactcctaccttataccatatacaaagattaacataaaattaaataactaaatgtaagagctataactataaagctcttagaagaaaacatagtgggtaaatctttatgacgttttacttagtaacagagtcttagatttgacaccagaatcacaataaaagaaaaaataaatttgtctactcaaaattaaaaactttttagaatcaaaggacactatcaacagaatgaaaaggcaactcaaggaattggagaaaatatttgtaaattacatttctgataaagggttaatatcagaattgttgaaagaaaatctttagccaaattaaatttaacagagtttaattgagcaaagaatgattcgcaagttgtgcagcctcctgagtctgagtaggctcagagactccaacacagccacatggcagaagaggatttacggacagaaaaaggaatatgatgtacagaaaatggaagtgaggtacagaaacagttgattggttacagcttagcgtttgccttatttgaacacagaacagttagctccctttgattggccaaaacttgatgattggcgtgataataggttacaaagtctgtttacacttccatttaggttatagttcactaggtacagagaagcctctaggctgaacttaaaatatataaggaggcagctttaggctaaacttgatttaacaaaatgtataaagaacttctacaactcaacaacaaaaataaaacaacccaattaagaaatgagaggtaacgtcagcaagatggctgaccttccacctagtgcttgtccttctcaaaaagacagaacaatgaacaaaaaattacattttaatgaaaataactgagggagagtctcggagtacatcagaggtgtaacagagacactggtgagcacagaaacttgggatggccacttagagaatggaatgaaacaccaagcaaacaccaccaccccatcccacaactaggatcagctgggacctaggagagcttttccctttggtgaggaggtaagcaagaggatcccagcagcccccatcaccatctcggacacctgcagaccctaccactcgggtcccctgcagtcctcaaggcactaagcctagctgagggagctgcctggggtccacacacctgtgctccctccagagacaaagccaacactgctcagcccctgtggcccacgtggctactgtgttccactacctaggagttggaactagagcgggagtgtgacttgctcctggagtagccgcagcttccctttatccttgaggcaaaactgccatcaaactaaccaagactggtggccgacatccccaagctgagctgcaagcagctgttacacccttccctgaggggccacgtggaggtggagctgcttcacctacccttcccctccatgcccataggccagagctgaagtggtaccctgcctcctgggaaaacagtaccttggccactcagagcggtcacacctccccagtgtcttaagttgaagcagttccctgcatcccaggaaatggtgcgttggccacccagagcagtcacatcccccaagcctgagctgaagtggcacattgtccccaccccccacccctgggaatcagtgccctggatgaactgagggctgtgcatcccagggctgaactgacatggtaccctgccatcccagataaatagagcattggctcagctgagacacccagccccataggccaaatagctctattgccctgctttcctggagctagacttgccccctggagtctgagctgctgagacagacctggggagtggagttccctgcctccccagggctcaaatgagagcggtgctctgccattctagggtacttgctgctgctacacctgttctcacagaacctgggatactgccaagccctaccatcccagggtctagagtaaccactacatggtgccttttcccctgggacccaagatgccactaacccctattggttcaggttcctgaattgcagctgtatccaacttctcaggcccaaaactccagagcaccccttcttcctgaattggaccagtgctatgccctgcccccaccccgcccaggagtagaatcacagctataatctcgccccctgggcctgagctgctagggaatggcttagaatcagatcctggcactgtgggcaacgtacacccaactctgccccagggagcaaacctgtaccccaacacccaggtgccacaataagttcatgagattctaagtataggacaccagctccacagccactctgagcacctgcacctggaacccagtggtgctgcagctgattgcaggccattagacctgataccaagaggtgtcccctcagctaagtcttcccattgtggggaaaacaaaaataacaggaccccaaaagcccttgacactgaggacatttacagcctacactgccacttctgctgccacaaacttctacaccctggacaactgaagtgcccacaattactgctaatgttgaatgcagctaaagaagttgtagggagactataccactgcacctggaaacagagtaactatgcccttcccagctggcacactaaaacccaactgtactgtacaaagtttggaagaggtgatttgttttaccagatgtacagacattaagggacacaagacacttgaaaaagcaaggaaatcaccaggtgtggtggctcacgcctgtaatcccagcactttgggaggccgaggagggtggatcatgaggtcaggagatcaagaccatcctggctaacacggtgaaaccccgtctctactaaaaatacaaaaaaattagccgggcgcggtggtgggcgcctgtagtcccagctactcgggaggctgaggcaagagaatggcatgaacctgggaggcggagcttgtagtgagccgagatcacgccactgcactccagcctgggtgacagagcgagactccatctcaaagaaaaaaaaaaaaaagcaaggaaatctgacatcacccaaggaacataactctttagtagtagaccctagtaaaaactaaatttaaaaactgacagaaaagggattcaaaataatgttcttaaagaagtgcaacaagatacaagaaaatacagatagacaatgcaatgaaatcagaaatgcaattgacaatatgaatgaaaaattcaacaaagagataggaatcataaaaaaagaaccaagcagatatcctgcagctgacaaattgaatgaatgaaattaaaaataaaaactaacaatagagagcttcagcagtgagtctgatcaagcagaagaaaaaagaaatctctgaacttgaagataggtcatttgaaattagtaagagggaaagaaaagaaataattaaaaagagtgaagaaaagccttcaagaattatggagcatgattaagcaaaaaaatattttatgggtgtctagaaggaaaagagaagggaaaaggtatagaaaatctatttaataaagtaatagctggaaaattcccaagtctggggagagatgtggacatccaaatccaagaagctcaacagtcccccaatagattcaaccaaaaaggttctccccgggacatgttatggtcaaactgtcaaaagtcaaagagaagagaaaattctaaaaacagcaagagaaaagcatcaagtcacatataacagaatcccccgttagactgaaagcagatttctctgcagaaattttatagaccaggagagaatggaatggaatggtatattcagagtggtaaaaggaaaacaaaaaacaaactgtcagtcaagaatactatacccagcaaagctatccttcagaaatgagggagaaataaagtctttcccagacaagcaagaagtgagggaattcatcaccactagaccagccttacaagaaatacacaagggagtcctacatctggaagcaaagacatgataattactatcgtgaaaacacacaaaaatataaaactcgctggtagagtgagtttcacaaaagagaaagagaaaataatcaaaccttactattacagaaaaccactaaaccgtaatgataaataatgagaggaagaaaggaagaaaagatatacaaaacaaccagaaaacaattaacaaaatgacagaagtaagtcctacctataaatgataaccttaaatgtaaatggattaaattccctcacttaaagtatataaactggctgaatagattttttaaatgacccaactatatactgcctacaagaagctcacatcatctataaggacacatatagagtgaaagtaaagggatgaaaaacatactccacgtaaacagaaaccaaattgagcaggagtgctatacttacatcagacaaagcaggctttaagtcaaaaactctgaaaagaagcccagtgtggtggtgcatacttgtagtcccagcaacttgggaggctgaggtggaaagattgcttgagtccaggagttcaaggtggtagtgtgctgtgattacacctgtgagtagccactacactccagcctgggcaacataccaagaccccatctctttaagaaaaaaaattttagggcaaggaatgtcattatataatgataaaggaatcaattcagcaagaaaatacaacaattgtcaatatatatggacccaacagtagagcacccagacatacaaaacaaatattattagatccaaaaagagagatagattccagcacagtgtcatttgcggatttccgtaccctatgctccgcattgaacagatcatctagacagaaaatcaacaacaaaaaacccacattggctttaaagtgccttttagtccaaatggacctaacagacatttccagaacttttcatccaaccattgcatggtacacattagctgcttcatcacatggaagataatctaggagagatcagatgttaggccacaaaacaagtctcaacaaatgtaaaataattgaaattgtatcaagtattttttctaacaataataaaataaaactagaaatcagtaacaaggggagcttttgaaattgtacaaattcatgaaaattaacattctcctgaaagacaaatgggccaaggaagaaattaagaaggcagttttacaatttggcctggcacagtagctcacgcctgtaatcccagcactttgggaggctgaagcgggcagatcatttgaggtcaggagttcgagaccagcctggctaacatggtgaaaccctgtctctacttaaaacataaaaattagcgggcatggtggtgggtgcctgtaatcccaggtactcaggaggctgaggcaggagaatcacttgaacctgggaggcagagtttgcagtgagccaagattgcaccactgcactccagtctgggtgacagagtaagactctgtctcaaaaaaaaaaaaaaaaaaagaaaaagaaaaaaaagaaaagagaaaaagaagcctgggcacagtggctcacgcctgtagtcccagcactttgggaggccgaggtgggtggatcacgaggtcaagagatcgacaccatcctggccaacatggtgaaaccccgtctctactaaaaatacaaaaattagccgtgtgtggtagcacgcgcctgtagtcccagctacttgggaggcggaggcaggagaattgcttgaacccaggaggcggaggttgcagtgagccgagatcataccactgcactccagcctggtgacagagtgagactccgtctcaaaaaaaaaaaaaaaaaaaaaaaaaagacagaaaaagagaagaaaaaaatattgaaacaataaaaatagaaacacatgtcatgataacttgaaccaggggcagggtaggtggagaagaaacatagcatgccaaaacttatgggatacagtaaaagcagtatgaaatgggaattttatagcaataaaagcctacatcagaaacacacaaagatttcaaataaatgacttaatgatgcatctcaaggaactaggaataaaacccaaaccaggccgaaaattagtagaggaacaaaaataataaagatcagaacaagagcaaaaagaaacaatattgagatgaaaacattacaaaagatcaacgaaatgaaaatatagccaggtgcggtggctcacacctgtaatcccagcactttgggaggccgtggcaagtggatcacttgaggttaggagttcaagaccagcctggccaacatggtgaaaccccatctctactaaaagtataaaaattagccagttatgttggcgggcacctgtaagcccatctacttgggaggctgaggcaggagaattgcttgaacccaggaggcggaagttgcagtgagccgagattatgccactgcactccagcctgggtgacaaagccagactctgtctcaaaaaaaaaaaaattgtttttttgaaaagataattgacaaaccattagctagattaagcaagaaaatatgcaaataaataattcagaagtaaaaaaggagacattacaactaatatcatagaaatacaaaggatcattagtgactattatgaacaactgtacaccaacacattagaaaacctagcggaaatggataaattcctggatgcatggaacccaccaagattgaaccaaggagaaaagaaaacctgaacagaccaattactgtaatgagattgaatctgtaatttaaaaatctcccatcggccgggcatggtggcttacgtttgtaatcccagcgctttgtgaggtcaaggcaggcagatcatgaggtcaggagatcgagaccatcctggccaacatagtgaaaccccgtctctactaaaatacaaaaaaaaaaaattagccaggcgtggtggtgcacgcctgtggtcccaagtactcaggaggctgaggcaggggactttcttgaacctgggaggcagaggttgtagtgaccggagatcgcgccattgcactccagcctggacaacaagagcaaaactccgtctcaaaaaaaaaaaaaaaaaaaaaaaaaaaaaaaaaaatcccatcaaagaaaagcccagggtgcttcactagagaattctgccaaacatttaaagaagaactaacacctgttcttctcaagctcttctagaaaattgaagaggagggaattcttctaaactcattctacaagactagcattaccctaatataaaaaccagagaaggacacagcagaaacagaaacaaaaacaaaaaacactagaaagaaaaaggaaactataggccaatatttctgatgatcgtagatggaaaaattctcaagaaaaatagtattttgtagtaattagtagtaactgaatccagcagcacattttaattcactgtgatcaaatgggatttattcctgggatgtaaggatggttcaacataagtaaaccagtaatcaacataatacattacatcaacagaatgaaggacaaaaacaatattatcatctcaatagacacagaaaaaaatatttgataaaattcaacatcccttcatagtgaaaactcaacaagttaggttggaagatacctcaacacaataaaggttgtatatgacaaacccacagccaacatcatactgaatggggaaaagatctacaacaagaaaggatacccactttcacaacttttattcaacatagtactggaagttctagccagagcagttatgtaagaaaaaaaataagccgcatccaaactggaaagaaggaagtcaaattgttcctgtttgcagacaacatgtcttatatatagaaaaccctaaaagctccaccaaaaaatccttagaactcataaagtaattcagtaaaatcaatgtacaaaaatcagtagtgtgtctgtataccaacaacaaactagcagaaaagaaatcagtctcatttacaatagttacaaaagaaataactaaggaagtgaaagatctctacaaagaaaactataaaacattgatgaaagatactgaagaggacacacaaaaaatagaaagacatttgatgctcatggattggaagaattaatattgtgaaaaggaccatgcagatttaatgcaatccctatcaaaataccaatgacattcttcatagaaatataaaaaaaatcctaaaattaatacagaaccacaaaagaccctggatagcttaaataatcttgagcaacaagaagaaagctggaggcatcacactaccaaactttgaaacagcatggtactggcataaaaacagaaacatagaccaatggaatagaatagagaactcagaaataagtatttgtatttacagccaactgatttttaacaaaagcaccaagaacatttattggagcaggacagtctcttcaataaacgatggtagggaaactagatatccacatgcagaaaaatgcagctcaacccctatctctcgctatttacaaaagccaactcaaaatggatcaaagacttaaatgtaagactcaaaaccatgaatctactagaataaaatacagggaaaacacttcaggatattggtctgggcaaaaattgtatggagaagacctcaagagcacaggcaaccaaagcacaaatagacaaatggggttgcatttcagtaaaaagcttctgcacagccaatgaaataatcaacagagtgacaacttgcagaatcagagaaaatattgcaaactatttatctgacaagctattaatatccaaaatatacaaggtgaaactcaacccatcagcaaaaaaaaaaaaaaaaaaaaaaaaaaaaaaaaatcagattaataaatgggcaaatgaactgaatagacatctctcaaaagaagacatacaaatggccagctggtataagaaaaagtgctcaacatctctaatcatcagggaaatgcaaatcaaaaccacagtgagataccatctcaccccagttagaatggctgttatcaaaaacacacaaaaaaaataacaaatactcatgagaatggagagaaaggagaactcttatacactcttggtaggaagcctcctcaaaaaactgaaaatagaactactgtgtgtgatctagcaattccactactgggtatatatccaaacggagggaaatcaattatgtcagagatatctgggctctcatgtttattgccatactattcacagtagccaagatatggaatcaacttaagtgtccatccacacatgaatggatttttaaaatattttccttatacacaatggaatactatttagccataaaaagaatgaaattctgccgcttgtggcaacatggatgagcttggaggtcattatgttaaggtaaataagtcaggcacagaaagataaatattgcatgttctcactcatatgtggaagctaaaaaaaaattgctctcatagaagtggagagtggaatagtggttactagaggcagggaaggttaggaggatgggggatagccaaaggttggtgaacggatacaaaagtacagctagacaggtgaaataagtttgagtcttctgtatcactgtagggtgactataattaacaacagtttgttgaatattttcaaatatttcaaatattttcaaataggagagcaaattttgaatgctcccaacacagaaataagtgtttgaggtgatggatatgctaattactgtgatttgatcattacacatttgtatacatgtatcaaaatattatactgtaccccataaatatatgcaattattacatgtcaattaaaaaaataatgaaagcaaaacaaaaatttataagaaagaaatgggcaaagggattgaatttaaaaaaaggaactgaataagtaaaaataagtaaatagctcctatggggggaaccagcccccagtatttcaacataggttcttttctatttttcctaagtgtcggctggtctgagaaataaagagaaagagtacaaaagagagaaattttacagctgggcctccgggggtgacatcacctattggtaggttctgtgatgccccttgaactgcaaaaccagcaagtttttattagggatttcaaaaggggagaggggtacaaacagggagtaagacacaaagagcacatgcttcaaagggcaataaaagatcacaagggcagagaggcagagcaagatcacaaggccagggtgaaattagaattactgatgaggttccatgtcccactaggcactcattgtcttgataaacatcttaacaggaaacctggtttgagagcagacaaccggtctgactagaatttgccaggctgaagtttcctaatcccagcaagcctgagggcactgcaggagaccagggcgtatttcatccctggtcgtcaaccacataaggcacacaatcccagagcagcagtctgtaggcctacccctgggaatgcattcctttcccagggttattccttgctgggaaaagaattcagcaatatttctcctattcgctttctgcaagaagagaaatatggctctgttctgcccagccctgcaggcagtcggaccttatagttatctcccttgttccctgaaaatcgctgttatcctgttcttttttaggatgaccagatttcatatcgttcaaacacacatgttttactaacaatttgtacagataacgcaatcatcacagggtcctgaggtgacatacatcctcagcttacgaagatgacaggattaagagattaaagtaaagacaggcataggaaattataagagtattgattggggaagtgataaatgtccatgaaatcgtcacaatttatgttcagagattgcagtaaagacaggcataagaaattataaaagtattaatttggggaactaacaaatgtccatgaaatcttcacaatttatgttcttctgccgtggcttcagccggtccctccgttcagggtccctgacttcctgcaacaagctcctgcacagccagtgaaataatcaacagagtgacaagacaacttgcagaatcagagaaaatattgcaaactattcatctgacaagtgattaatatccatttctccaaatacaatgaccaataagcacatgaaaaaatattcaacatcactaataattagggaaatgcaaatcaaaaccacagtgaaataccacttcacacccagtagaattggtattactaaagaaaaaaagatagaaaaagaaaagagaataggccaggtgcagtagctcacacctataatctcaacacttttggaggccgaggtagacagatcacctaagttcaggagttcaagaccagcttggccaacatggcaaaaccctgtctctactaaaaatacaaaaattagctgggcctggtggtacatgtctaatcccagctactcaggaggctgaggcatgagaatcgcttgaacccaggagatggaagttgcagtgagccgagatcatgcctgggctacagagtgagactctgtctcaaaaaaaaaaaaaaaaaaaaaaaaagaagaagaagacagaaaagaaaagaaaatagaccaggtgcagtagctcaggcctgtaatcccagcactttgggagtccaaggcaggcagatcagttgaggccaggagtttgagactagcctggccaacatggtgaaattctggctctactaaaaatacaaaaattagctgggtgtggtctcatacacttgtaatcccaggtactcaggaggctaaggcagagaatcacttgaacctgggaggtggaggctgcagtgacctgagatcacgccactgcactccagcctgggagacagagcaagactccatctcaaaaaaaaaactaataaattaattaaattaattaataaatattggcaaaaatgtggagaaatttcaacccttgtgcactggtgggtatgactgtaaaatggtggtgtggaaaatagtatgatagttcctcaaaatagtagtaaaagtgaattacagaatgatccagtaattgtactcttggtatagacccaaaagaaatcaaatcagggacttcaacagatatatgtccacacatgctcatagcagtgttactcacaatagccaaaaggagaaaggaacaccagtttccatcaacagatgaatgggtaaacaatgtatgaacattcaatggactataattattcagccttaaaaaggaagagcgttctgacacattctacaatgtgaataaaccttgaagacgttatgttaggtgaaataagctagtcacaaaaggacagacactgtatgattccacttatataagttacctatagtagtcaaattcatcgagacagtaagtagaatggtggtttccaggggaggatggatgaggaattattgtttcatggatacagagtttcagtttgggaatacgaagaaaattttggagacggatggtattcatggttgcacaacagtgtgaatatacttaatgccactgacctctacacttaaaaattgttaaaatggaaatttttttgttatgtatctttactacagtaaaaaaaaaaaaaaaaagaagaagaagaagaaagtgaacactcaaacttctcccaaatatacaagaggaggaaacacttcctaacacattctgtgaggccagcattgcccttatatcatggtcaaatatgccacaagaaaagaaaactgcagacttatatcccttatgaatattgatccaaagatcatcaacaaaaatactagcaaactaattccaacaacacatttcccaatttcaaaatgtactagaaagctacagttatcaaaacaatgtggtactggcataaagatagatacataggccaattaagtagaattgaaagtccagcaataaactcaaatatctgtgttcaattgacttttgacagttgtgctaatgggggaaagaattgtctttctttccatgataattcagtgagggagagaataatcttttcaacaaataatatggagaaaactggatatccacatgcaaaagaatgaggttggacctctacctcactcaatatacaaaattatctcagtcaatcaaaaacctaatagaatagcaaaaattatgaaactattagaagaatacataaaggataaatcttcaggacctcagaattggtgatggattcttagatttgacaccaaaatcataagcaaccaaagaaaaaatagataaattagactacatcaaaatttaaaatttttgtacgtcaaaggacattatcaaatatgtggaaatacaatgtacagaacaaaatacttgcaaatcacatatttaataaggggttaatattcagcatatataaagaactcctacacctcaacaacaaaaaaccaaacagctcaattttttaaatggcaggggataagagtaggcatttctctaaaaaagatatgcaaatggcaaacaatcacatgaaaagatattcaacatctttggtcatcaaggaaatgcaaatcaaaactacaatgagatacctctttacatccaccatgacagctataacaataatttttctaaaaattgaaaataacaagtgtcgacaaggatgtggagaaggaggaactgttgtacattgccagtaggaatgtaaaatgcaccagctgctatggaagaagtttggcagttcctaaaaaaaaatgaagcatagaattaccatatgacccagtaatttcactcctaggtatatacccaagagaaatgaaaagatgtatctgcatagaaacttgtacatgaatgtttatggcaacatgaatcataatagtcaaaaggcagaaacaacccaaatgcctatcagtgaatgaatgtggtgtattaccactggaatgttattcagccataaaaagaagtgaagtactaatagatactacaatatggatgaaccttgaaaacattaagctaagtgaaagaagccagacatcaaatcatattgtgtgattcctttatgtgaaattccagaatagacaaagccatagaaacagaaaggagattggtggttgccagggggttgggggggcggggattggggtggtgattacccaatgtgtatgaggtattcttcgggaacgacgaaaaaagttttgaaacgagagagatggttgcacaatattgtgaatacactaaatgcccctgaactgtacattttaaaatgggtaattgtatgttgtgggactttaaacttaattttaaaataagaacccaaattgttggcccgtagagtccaaactgttaactgcacgtcacggatttcatggaaggccagtctgagagggaaagacaatgtgatcacagagaggaagggagggagggtcatggacaggaaactccggggcctgaaatagggcaagacactagcatgtggattccagaaccccgtgaaggcaggaagtcttggaagtcccatggggagagcagatcgggcatgtgctggtcaaatcagagtgacccctgctatcctgagagcttcacacacactggagagtggtggggggcggcggggagggcaggctgaggtctctctccgtcacctgttctccttcctgtcctgcagatgttgaacctctttgtggctgtgatcatggacaattttgagtacctcacgcgggactcttccatcctaggtcctcaccacttggatgagttcatccgggtctgggctgaatacgacccggctgcgtggtaagtgagccgtggtgctctgtggtccttgggggtggtccatgcccatagatcttgggatgggcctggtggcttcagacatgtttcaagtgagcaccccctcaggttttggtttggggcctagggatctgtcctgtttcgtgtagagcagcagtgatgtcccctccgagcagcacctcccttttccatctcgtgtgccttcgcgcagtggcccggactgcataaagtgataagggtcttttgagaccttgagttcagttccttgggaggtaccaggagtcatggaaggttttcaaggggcttgtgagactcaggtcttctgctgaaatttactgtcttctttcaaggcctgtcatgtgagggctcatggagggcttgtgggagggtgtgtggagacagcacagccatagcgtccttgtgagactcgatgtagggttttaggacattctccctaaggggctcaggagtctccctctgctctttcttttggggacaggggccaacatgcacctctgtgtccccagcccaggctgcatatagtgtgggtgcttggtgaacttttttgacagatgagctaccaggaaggctgtagtgtgtttaagacccttgtctatcatctgtcatcgtgggaaaggtttacttgtttcaaaggcgaggggtggtgcctttccagacagaggaggagtcgcatgaagggcatggtttgggtcagaaggtgaagctgtttgagatcaggatccatgggggtcccgtacagcatggcatctcagcagggctgagagctcattcgggaaggaagacaggtcaggcagcatggcttctccatctttctgtttgtccattccttccatcactcgttcctcatttacttgctcgctcactcactcaagcaatgtctactgtgggctgctccctgcaaggccactaggcctgctagcacctcactcacagcgtgtgcccgggaaatgatcgtggatgagcagctctcagtgagtgcgtagacatccaccactccccgtgccctagggggatgagggaaccgtgggtgccaccgaggcctgccttctctctctgagctcctcagcctgcccaggccccctcgcactcctctgcccccagtgcccttactgggggagggccggcaggacgtggtcagacccctcatggtgaggtcctactgcccacagagctcctgggttctgcctggttttgcttaaactgcagctcagcagagggagccctccacagacacaaaaggcctgggagcccgactagacttccccaccctcctttccactcagcctccccggagcacccccaccttcctagtgaggatccagagggtgctgcacgggcccttcccagtctggacaaggtccagagccactggcagcatcgggggccctgggatggggcctctcctgtccaggctcttccaggcacacagcatctctgtgggtgtttttcatttgagtcggaaatatacagtttttacgcagtgcaaaacagacgtagagattgtctgtgtttcacagtgtatatgacaatttccgtggcttgcgagaaccctgtcatgtccgatgcagcaatatgtttgccctgtgatacttacttcatgctgggagggacaggctcaggcacattcacacaggacctgtggtcaagtaagcccagtcgacctgggggagactgaccacattgaagacctagaccttgttaggcaaagggcaggagagactccagccgaggcaggatttaggtgaattctaggcaggtcaccctgaatgtgtggtttagagagtcgctgctttttctgggtgtattttttctggaggagactgtgttgcagaaaacagagatactttatagcatgtagttagtactgaagggcaaaggcagatcaacaaaggcctgtgagaggatgacaacattccccaatctttatgagctacgcccgggccttccacagtcagccgccggcaagagcagaggcaggaagaacgggaagtggacttgggccagatggcagcttggttaccatgcacagtggtaccataccaaagccagagtctcagagcaggggtccttagaagacataggcagtcggggatgtgagaagtgcttactgaagagtaaacaacagaatacaggcctcaccccagagatagcacgcacaaaataacacacaaaacctgcgggccttgagatagcacagacgtgacctgtgagcaacacatgattctgcccccacgagcagcctgggctcaccctacgtagtccaagatggccaggacaggccgaggggcccagcagaggcagctgagcagattgggcctggatcctgtgtcctgagcagagcacagggcaccttgagcctttttggtagcctctgtgacaaacgcagtgatgtagtcatttcccaggggaccactctatggctcctcgttctttgggagaaactttgaaacaacaacaaaattttatgagatttcctgagttgtgtgtgcacatgtgtggtgcacaaacaggacatgtgtgcatgtacatggctgtgttgtgtgcgtgtttgcacagtgtgaccacatgtgcactctgtgcatgtgtacatgtgtgttgtgcacgcatgcacacagatgtctacatgtgtgttttgtgcacatgtgcatgcacaaggcgcgcacgtgtgtgcatgttgacgtttgtgtgtgcacatatgattgtatatatgtgtgcctgtgtgtatatgtgtgcaagtgaactgaatgtgcgtgcatgcctgtgtggttgtatgtggatgtgtgtatgaatgacatgtgcacctgtgtgtgcatatgcccatgtgtgcatgtgtgtgcctgtggatgtgcacatgcccgtgtgtgcctgtggtgtgcacgtgtctgtggtgtgcacgtgcctgtgtgtgcatgtgcctttgtgtgtgtgccaccgtggtgcgtatgtgcctgtgtgtgcctgtgggtgtgcacgtgcctgtggtgtactcgtgcctgtggtgtgcatgtgcctgtggtgtgcatgtgcctgtggtgcgcatgtgcctgtgtgggtgtgcatgtgtgtgcctgtgggtgtgcacatgtctgtggtgtacacgtgcctgtggtgcgcatgtgcctgtgtcggtggattctgaaggcacgaaactgttcaccctggtgctgcttttcccagccttcctattgttgttgcttcaaccctgtggtgtgaagcctggtgacttgagaggagaattgcagtcacacttcttgcagcaatctggctgctcatttctgtgtccacccatctgtctaataacatctcctgggcatctgccatgtgctggggcaggggcccaaaggtgaaacaggcacatgctgtcagaacactcagccaggcttggcagtgagaccacatggtgactgtagctcaaggccagggcatttctgaggaaggagaggccatgtctggcctgaagaatgagaggaggtgccatttgagctgaacttaaaggaataggaaggattgagcactagagaaataggatggattgagctggggatgggaggtggggcagagggaagagggaggccaggtggcttctgtcaggctggagaggagagtgcattgcagaggggctgcaaggaaggctgagaccgtttgagaaaggcattgaaattggttgaacaagtcgctttgattttgcgttgtagacagtgggctcagtccttgcatcgaggagtgatggtgtcaggcccacactttccacctgggcttgatgggcagggacagctggggagggtggggggtctcacgtgtgtccagccccccgtggtggtcccttggctgccacaaccttagcaaacatctttggtgaggccgaggtggggcttcctgtttcttcccttttacagaaggaaattcaacatgatttggagctgattggaccgagggggctacactgtaggagagaggagcattggtggtgatccaaggatgccagcctacgatgagaggaggtccttagctggaccagggcttccaggggaggacacagagtgttcagggagacagggtcagtcaggaggcaaatgggtatgggcctctgaggttgctgtgatagagaagcagacctgccttgctgtggtggtgagaaagccaggcgtcagagggtttggctgacctgggaggcccagggagcatcgtcactcagggagtgagaggaagagctgaccgagagggaggggcagggcagtgttctgtgtggagcggctcctgcacacatcgggctccggaaatttcgctggggttgccacacctcccggggagctccaagccccagtaccccggcgaggtgccacctgtccagtgcacccctcacctccgccgccacgcctgcgcgaggtcggtcttcccatcacaggctgggcgggcgggagggtcgggctccatcctgcctttgttgccataacctgtgacatttcctttccagttgccggattcattataaggatatgtacagtttgttgcgttgtattgcgccacccgttggcttagggaagaactgccctcgtaggttggcctacaaggtttgcaacttcagagcctccatccaacatacttccctgcccgaaacgcacacagcacacactccctgcctggtttgggaatgacgacgcctcacctttctttcctcctgtcctgccccgcactccagcctcctggacgctttggttccctgtctaatctcccctgacccttctagctggctggggacaggcagccttttgagagtgcacagaaagctttctggttgggatcagctagctgggtgggagatgggggctaggtccctcctgcatcaaggaagcagccgacttgcccggtttttcctccgagctctcgagagtgagctgatggtcaggccaaaggccgagggccccagaggaagggagcacgggcacaggcctcccaggagcagccgtcctctgggttggaagagcccagtaacccagtggctctccagtccctgggggaggaaagggcagaggcagagtgggggccaaagacaagccgtcctgctttgcctctggagtgatgcgctcagctcagccaaggagcccctggtctggaaccgtgggaggagggcaaggccccagggcagatccatctgccaggaagaggctgtcccctttctctcctgggccacctgaatctggctgtgtctctaggaccccaagcccacaggcaggtgtcccagggttggaggtaggccccaggcctcgtggcctctctacttgggaagactctgtcatcggagcctttaggttcctagatcctgcaacctgcccctttgctgtcagagctggtgcaaggtggccccaggccatgtcctgccagctcctcccccctcccgcagtctcccatttcccacccagccctgagccccagcagcagccctgccctgggctggcctcgggcgtctctgggcttgaagcaggacttgccccaaggttaggttttggctgtacagcttcagggctccctgtttagttttctggtttgtttcagatcttctccacctttttagcctctagcctcacttggaagcaaatctgaccgtgaggaaagctgatgtctctgccgtggttctcagccactgcctcatctgccacctgaccccgcctgccagctcttctggcagggtggaccagctcttttctgattggcattcactgtgatttttaaaagagtaaaatcagaaattatcaacccaaagccgccccgatgcagcccttcctcacccctccatgttcattagctcagacgccacccccgcccactgccccgcgtggggctggagtgaggaggtgaggctcgggggtggggggccaggagggggtcaagccaagcagagaaatccctcattttatttattttgattttgggctttgaatccgacactttgattaactggctctgttttcttgtctgcttcctccctgcccctaccccgctcccctccccgctcccctcctgctgccgctcctcctgtggaccaccccactgtgccctggcctcgctgggacgggtttccagtgggcgcatcagttacaatgacatgtttgagatgctgaaacacatgtccccgcctctggggctggggaagaaatgccctgctcgagttgcttacaaggtagaccctgaccctgcaacccgccccccaggaggctgtgtgtgcttgctgaggggtgcttgctggctctcccagctcctctccctttcagggtgcccggctgtctgtctgccgctctgctgtgcgcccccggctgcctcactgtgtctttctcttcagccccatcccagcttccttcccagacagagggatgtggccaccatgatgtctcactggcctcttgtccccacaacctgagctgccccctttgagagccccctggaggctcaggaagacagaactagaccctcctccctgccttttctccctcccttcctttcctaggaatgaggggacagaccacttgtttgacagagattgtttttgttctgggctcagaacaaagccctaagcccctggtatggatggagctgtccagccctctgggtctggccctgggggcaggtggggcctgcagggcctctggtgcttctgtacaaccccctccccagctcagcaagtgcagaggctctctgggcccaggctgcagtctccagggactttctaggctccatggtggggaagaggcactgtggcactgagaaggaaaggggtgctggggagaggcatcttgctattattcctggggcctcagagggctgctggaggatggggatggcctcggggcccaggagtcatgggatgctgagttgccaagaagggggtaaatcgagggatgcctccaggcctccctcctgggtgggcaagcagatcacatggcccagccctaaaactgttccatctgcccagctgtccccagtcccacctcataccctccatgtgtaagcaccttcgttcccccagcacccacccacctactcaagagccctcctgaggcccccactgctctccggcaaacggcctgtggttcagccaacacgtgcctagagcttttctgatcctccctgaggaagactttcctgagtctgtctgaggaagcttcctgccagagctttcctctctggtgctgtggacagctgttgtccacactggctctgtgccctgactctaggtctttgtcacccgactcagtgcagcctgtgggagccaagtggctcctccaagccatcctcagcccctgccctgcccctgcattgtgcctgcctgggggttctgcatgcaaggctgtagctttgtccccaagaaggagagctctgtccacacttggcgccggggcaagcaggcagggccatgatggagcagcctttggagccccacccagctgtgctggctgactccaaggttctgggcatggagagaccaagggaggcctcagggtgggggcagaagggccagatgagctgaggagggtccaggagatgcccagagcactgcaccttggagggcccagggcagagacacctgtttgtttgccctggccttgcctcttggcttcttcctgagattcttggccctttggggcctggagtgggctgatggcacccctggggagggcagccctccagtgccctgggcggagctcttccttcttgtaaatcacctgcctgctctgccctcactgctatccccaacgccccccaacgcctgccctgtgggagaggaattccttggcctctcacaccgccattcatgctggtctgcagggatgccattctccgggaagccgtttactcctgttgtgctgcacacacatgctgtgcaaagccctgggactaggactggacgtggcaagtggggctttgccagcattcggggccagagtcaggctcatgtctccagcccggcttgcatccacaccccactagctattaggctgaggactctggatttggggccatgatgctaggggcagggctgtatggccctccctagagaagaggctgccctgccacaggttgcaggcttgggcaaggacaggcagaccctggggaggagctcctgtctctagctggacagtgctcctggggctccacttggccagctccttgctccccacgctcaaaatattccaggcacacttgagatgcatttcctccttggggcctcttcagttcttagagcctgggtctctgggcagcactggctggggccagaggactgtggtgcagacacgagctcgtctccagctgttctgtccctgaaaactggcaacaggctgtccacctgagagggagacggagcagagctgcaggacactgccccagcccactctgaagtgtagcagcctcagcctgcagccctgggaagtcccatctgttcctgtccttccagcagcaggagctgccttgcgcagagatgggctctgccttttagtgacatcgagcatctctcccaggcctcatgctgggtggtgagaggcagaagcctcactggacctgagctaaaaccaggatgtcacctgtaggggcccccactgggagctgggccccagagaggcaccctggaccacctactccttgtccagatgatcgaagtggtgggaggagaagatgggggtgggcagagcaatgagcacagggacctcttctgtctgtggctgctgctcctcctccccagccaaggctacactcctacattcagccacaggcaggggtccctcagggtgaggaggtggctgtgctttcagagggatcaaggctccagtctttacctggagttctacttttctgcagccaggagggtcctcagctagatttgtggggcggggagtccaggggagagtgtgaatgctggcaaaactcccacccgccccacctcactcaggcctaggcacctgcaggcaccaccactgggatgcccagcccagcatccagggaccccatcattgcgtagtcttggggtggggggtgaccccagcaggcctggccctgaccggccctgcttgtccctagcgcctggttcgcatgaacatgcccatctccaacgaggacatgactgttcacttcacgtccacgctgatggccctcatccggacggcactggagatcaagctggccccaggtgagcaaggcagcctcggaaggagggccctggacccagggatgtgcacctccgccctcagtgtcagccccaggaggacacgcagggaggagggtgaggggccagctgtgtctggaggggtctgaggacagctgcacaggatacccaccctggggcactggctttttcgcctggtaaccgtctgcacattagcactgcaatgatcccattttcaggtaaggaaactgaggcatggtgagatttcataaattgcccaggtaattcagagccagctggtggtggaaccaggacacagcctggtcaagcctcaccacagccagcgccctccctggggacgagcctgcatgcccttggccccctcccatagtgagcccatccggtctttccctgatctgatggacagtaccacagagcgatgccaaagcaaggagagaaggagcctgtagtgtgttcttccccacgtccaccttccccaccacagaggagattacagccccagagggccctgccccagccccacccccctgcgtctgccccatctcctgctttgtgtgccaagcctcacttacgtctccccaagggtgccgtagtggcaatgccatactgtttcttgccctgtctactgggttatttgtgtcagcatataaacacccgattatttcctccatcttcaaaaagttcgctgggcgcggtggctcatgcctgtaatcccagcactttgggaggccgaggtgggcggatcacgaggtcaggagatggacaccatcctggccaacatggtgaaaccccatctctactaaaaatacaaaaattaggtgggcgtggtggtggcacgtgcctgtattcctagctattcaggaggctgaggcaggcttgaacctgggaggcggaggttgcagtgagctgagattgtaccacggcactccagcctggtgacagagcaagactccgtctcgaaaacaaccaaaaaagttatcttcccctctgtcgacttccctattctctcctttctaatgccctgctcttgagaggttgtctctgatttccctttcccacatgctgggggctcttcccagcttcaccagagctgcccttggggtctccaggcctccacgttgctcgactcaaaggctgaggcacatccccagctcatgggctgtccatggccgtttctccatttgcattttcttctctttgaaccttttttatctgtttctccgatcccacaaactttgggtgtgcctttgtgccatggaatgttctctctacactcactcctttatcatctcacctattcccatggctttaaataacattaatctcctgacttctctcctgaacttcaaattttcccccacagccttccctatctcagtcaatgcttaagccgaaaccttagaaatcatcttattttatttatttatttatttatttatttatttatttatttatttatttatatagggtctcactgtgtcacccaggctggagtgcagtggtgcagtcacggctcactgcagcctccacctcccaggctcaagtgatcctcctgcctcggcctcccaaagtgctgggattgcaggcaccactcctccatactagtttttgtatattttttagagatgggggttcgctgtgttgcacaggctgaggatcatccttttctcctccttccttatcccatttctgattcatgccttctctttcatattttcttgactctgtctttaaaatatatccaaaatgtggccactcctctcccttaccccattgccgcctcctctggctctcagctgttgctgcagcagcttctaattcatccacttctgcccttggccccttctgtctgccttcaacacaacagccagagtgatcaggttaaaaaaaagactaatggccgggcgcagtggctcacgtctgtagtcctagcactttgggaggccaaggcaggcagattgcctgagctcagaagttcaagtccagcctggacaacacagtgaaaccccgtctctactaaaatacaaaaaattagccgggcatggtggcgggcgcctgtagtcccagctactcgggaggctgaggcaggagaatggcgtgaacccaggaggcagagcttgcagtgagccgagattgcgccactgcactccagtctgggtgacagagtgagactctgtctcaaaaaaaaaagaatagataaccttcagtttcaacaccagaggacaaaaaaaaaaaaaaaagagataaccaggccaggtgccctggcttatgcctgtaatcccagcagtttttgaggttgagggaggaggatcacttgagctcaggagtttgagaccagtccgggcaacacagggagcccctggctctacaaaatattaaaaaattagctgaatgtggtggtgaacgcctgtgctcccagctgcttggggaggctgaggtaggaggaatgagctgtgatggtgccactgcactatagcctgggcaacagagtgaaaccccatctcaaaaaaaaaaaaaaaaaaaaaagcaaaagcttcataataccatatatattaaataaattaagtttagagtggaaaaaccttccaagaaagacaatcccaggtccaaatggcttctttattgaagtctaccaactgtttagggaagaaataatgccaattctgtatagactcttccaaaaagtggaaaaagggaatattttccaacttattttattttcagaggccagctttgctctgataccaaaactagacaaagacatgaccagaaaagaaaactacagacgaatatcccttataaacatagatttttttaaatcttcaacataatctttaagcaaactgaattttttttttttttgagatggagtctcactctgttgcccaggctggagtgcagtggcacgatcttggctcactacaagctctgcctcctgggttcacgccattctcctgcctcagcctcccgagtagctgggactacaggtgcacgccaccacgcctggctaacttttttgtatttttagtagagacagggtttcaccgtgttagccaggatggtctccatctcctgacctcgtgatccgcccgtctcagcctcctcccaaagtgctgggattacaggcgtgagccactgcacccggccaaactgaatatattttaaaagataatatatgatgacacaagtggggtttaccccaggataagttaggttcagtgtttgaaaatccagtttactgtatcaaagaaggaaaagtatatgattatctcaataggtatagaaaaagcatttgacaaaattcaacatccattcatgatttttaaaattttacataaagtaggaattaaggaaagcttcatcaatcatgtatcatagactcacttatacggtcaattgatttttaacaaacttggaaaggcaattaatggagaaaagatcatcttttctacaaatgatgctggagaaatttagacaatcctatacaaaaagagacattcttgacatgccgttttagcttgctcgggctgccccaagaaaatatcacagcttagacaaaagaaatgtatttctcacagttctggaagccagaagtccaagagtttgtgtttgtgaggtgggtgtcactcttaggcctcttctcttggctggtaaacagccatggtcctgctgtgtcctcaaacagacttgcctctgtgtgtgcagggagagaaaaagagcaagtggatttccaggtgtctcctatgagaccactgattctgtggatcagggccccacaggaactccttgaactgatcacctccttacaggccccgtcaccaaatacagtcacatctggggcttagggcttctacatgtggactggagttggggacagcttgatccatagcacataccttttaccctgtacaaaaaataacttgaaatggattgtagacagaaacgtaaaatctaaaattatgaaacctgtatagaaaacacaaggccaggcgttggtggctcacgcctgtaattccaacactttgggaggccaaagcaggcggattacctgaggtcatgagtttgagaccaacttggccaacatggtgaaacccgtccctactaaaaaaagctgggcctgctggtgtgcacctgtagtccctgggaggctgaggcaggaaaattgcttgaacctgggagtcggaggttgcagtgagccaagatagtgccactgtactccagccttggtgacagaccgagattccatctcaaatggaaaaaatcgataaattgaactacagcaaaacttttgctatatgatatatatatatatacatatatatatatatttgagacagtcttgctctgttgcccaggctgcagtgcagtggtgcaatctcagctcactgcagtctctgcctcctgggttcaaacgattcctctgcctcagcctcccaagtagctgggattacaggcacatttcaacacacacaactaatttttgtatttttagtagagacggggtttcaccatgttggccaggctggtcttgaactcctgacctcaaatgatccacttgccttggcctcccatagtgctggaattacgggagtgagccactgtgccccaccacaaaagatatttttaaaaatgaggccaagtgcagtggcttgtacctgcaatcccagctttgattaactttgagagaagaggtgggaagattgctggaatccaggagttcaagaccagcctggacaacaaagtgaggctctgtctctacaaaaaataattttaaaaaatcagctgggcatggtggcgcatgcctgtggtcccagctactcaggaggctacggcggaaggattgcttgagcccaggtgttcgaggttccagtgagctgtgatcatactactgcactccagcctgggcaacagattgagaccctgtctcaaaacaaaacaaaaaaccagaatgaaaagacaagcctaaaattggagaacatatttgctaaacacgtatctgctataggattagtattcctaatatatgaagaactgtcacaactccctaagaaaataacccaaccaaaacagacaaaagatttgaacagaagtgtcatcaaagaagatatatggaaggcaaacaaacacatgcaaaaatgcttgatgtcattaatcattagacaaatccagaatttaaaaaaaaaaaaaccacaacgagattacactccagtctactggagttgccaaaatgcttttcagaatgacaatacttagtgctgagagggcagagcaactggaattctacatgttcccagtcggaaaagaaaatggtgcagccccttagacagtttgccgttacttctatggtccagccattgcacttaggaaatgaaaacatacatccacacaatctatgtgcagatgtttacagctttattcaaaattgccccaaactgtaaacaactcatatgtccatcaattggcaatggataaacaaatggtgcattcatacaattaaagaatactcaggagtaaaaggaaacacgctacagttgcgtgtggcaatgtgtatgactctcacatgcaccacactgtgtgaaagaagccagattcaaaggccagtgtgctgtatgatgccattggcgtgacattctggagcaaaactatagggacccaaaacacatcagtggtggcagaggctgccagtaggacgaggggtcgactcaagggagcacagaggaatttgggagtgatcagctgttgcacaccttgacggtgctgctaggcacatgggcgtatgaattcaccaaagttcatagagaatgaaaaagggtgactctcactgcatgtgaattgtaccttaataaacctgatgttcaagaaaggtgaatccaattattttattcctctgctcaaaaccctccactgccttccctaaccctcctgcccacccctccatccaccctgccccgaggcctccctggcccttcgggtgacacagcagggccagtgtactcgggggctccttttaccttcagggcacacaggcctcctcgggagactgatggccgtcctgtccacagccgcagccctgctgatattccccttccccgctctgctctccttgccttggcactttgcactctccggtacactttttttttttttttacttattactgctttattggtagactaaagcgttgtcaactccagaagggaagtttttgagagttttttggtaaatattgttgaatgaatagatgaatgcctggagtgctgccatcttcctcctaaatcctcattgcccgtcccatgcacacacgaacgtgcagtgcacatgcatgcacacacgtcggacacacacgtgtgcacatgaggtggttgccctgctcacctgcctcctcctctgggcagactcgcagcagggagggctgtgagcagcttctgcatcagcgtttgttcccactgcaccctccttccagcaccgtctgtaccccatctccgcctacaccattcatctccccacctgcaccagctctgccccattggcggctgcagggctgctcctaacatctctgtcttttccccttccccaccatcatcctggtgcagctgggacaaagcagcatcagtgtgacgcggagttgaggaaggagatttccgttgtgtgggccaatctgccccagaagactttggacttgctggtaccaccccataagcgtaagtgtgagggtgagaaatgcccccagcccccacctttactgtcccacccagagtggctggagggctgtggaggtgagggtgagggatgaagggcaggccaccttggagaggtgggctcacctcctcatgaatctgccctcagctccaaccaagagagccctgggtggcagaggagctgcagagatgagcgtgggtttgttgtgttgagctcctggtgtgtggaatttattttttttaaatccagaggaaaggcaagaggggatcccacagggatgtgagggagtgcggtgagatgcccaactccatcttgtgagagacgtgagggagcgcggggaggtgcccaactccatcttgtgagagacgtgagggagcgtggggaggtgcccaacttcatcttgcgggagacgtgagggagcacagggaagtgcccaactccatcttggagaggtgagggagcatggggaggtgcccaactgcatctcgtgggagacgtgagggagcgcagagaggtgcccaactccttcttgtgagagacgtgagggagcacggggaggtgcccaactccatcttggagacgtgagggagcacggggaggtgcccaactccatcttgtgggagacgtgagggagcacggggaggtgcccaactccatcttatgggaacgtgagggagcgcggggacgtgcacacctccttcttttgagaggcatgagggagttcggggaggtgcccaactccactgggaggtgcccaactccatcttatgggatacatgagggagcacaatgaggtgcccaactccatcttgtgggagacgtgagggagcacgaggaggtgcccaactccaacttgtgagagacgtgagggagcacggggaggtgcccaactccatcttatgggatacgtgagggaacacaatgaggtgcccaactccatcttgtgggagacgtgagggagcgcgaggaggtgcccaactccatcttgtgggagacgtgagggagcgcaggaaggtgcccaactcctccttgtgggagacgtgagggagcgcaggaaggtgcccaactgcatcttgcgggagacgtgagggagtgccgggaggtgcccaactccatcttgtgggagacgtgagggagcgcaggaaggtgcccaactcctccttgtgggagacgtgagggagcgcaggaaggtgcccaactgcatcttgcgggagacgtgagggagtgccgggaggtgcccaactcctccttgtgggagacgtgagggagcgcaggaaggtgcccaactccatcttgtgggagacgtgagggagcgccgggaggtgcccaactccatcttgtgggagacgtgagggagtgccgggaggtgcccaactccaccttgtgggagacgtgagggagcgcaggaaggtgcccaactccatcttgtgggagacgtgagggagcgccgggaggtgcccaactcctccttgtgggagacgtgagggagcgcaggaaggtgcccaactcctccttgtgggagacgtgagggagcgcaggaaggtgcccaactccatcttgctttctggggaggagacacaggaagggccctgcattaagcaggtggggatggcctcagcccggtcttgagaggcctcaggaggagtcagggcagtcaggagggccaggtcagcatctggaggagccctaggtaggccaaactcctggtggccgagccccatgttctgcctgagagccctctgtcccagtgcatttccaggagtctttgtggggggcgagggaggggcggctgtttcctcaccttacttccataccttgtttccgtggatcctctgcccccttctccgaatctcaactcctgtgttcttttccagctgatgagatgacagtggggaaggtttatgcagctctgatgatattcgacttctacaagcagaacaaaaccaccagagaccagatgcagcaggctcctggaggcctctcccaggtagctggcggccctcagttttccaggaaaactgtgatgcctccgaggctctggcatccttcggggggttgacgacgggggagatgcacaccattcttggaaaaagtatctcagaaggaagatgaaagattcttgcagctacctctctggcccccagagtcagaaactacacacagcctttatgctttccatgagctggcggtactgggcagctcctgacatagaaagtcagcactcagggccagaagttgagggctgggctgggcagtgtcatggttgttatggggtggaagagaagaagatgtgaagaccatttgaggaggattgtttggagaggtgaaaggagaactgttttcccttcacacagagagcaaagaaattcagataggtacaggatcattgtctgttctgctcttgcctttgactgagatgatttggggacccatcttcccgatgtcgtccttcccacacagccgtgtcttcggtgaccatatgtagtctgtctgctggaaaattgtctagatgtccagggcttctggggacattgacctagtcctcagatggagaatatgtggtgctcaggccacaccttccattctcacacctggggtagacatcactaatccatgcagcagtcttccccagccctgaaatctcggaattttgctcagcccaaccctaaccctaactcctaccagccaattcaaggtgatgattagatggaatattgttgccacctgtaatctggtccaatcccctagttgtgtagacagggaaactgaggttttgagaggtgacatggctttcctgaagtcactgacaggcaaggttttgaggagatgctgtaagggtcccctggcttgcttcactgttttggtcacatgctcatatttagggacatatcagggaaagtaagcggccccttgctaaggggaaagagcccttaggctgggcttgaacatgacctggcttttgccccatgccacatggtcagagcaggtcacagaggccacattgcaggcccattggagctctttcccttccctttgcctcctttgcagatgggtcctgtgtccctgttccaccctctgaaggccaccctggagcagacacagccggctgtgctccgaggagcccgggttttccttcgacagaagagttccacctccctcagcaatggcggggccatgtgagtatccagatgcaggacatagctggacaggaggaggtccaaagacagtaaagggggaagcagacatcccatttcctcaacctccctggccctcacttccactggcctctgggttcaccagcttggaggcacctgaggggcgtgtctgccatccgaccctgcacttgggcccttagcaaccctccaaggacagagagcccctaggccacatctcagttctcaggggctggctttgctacagatgcttgttgtacttgctgcctgagagcagtcaagggctcttcctttgctgggtttctgtggcagactttaaaatcgtttcctgtgacattagacaggtgcttcatcgaacccgccttcctaacagcacttagaccaccacgtcccattcccaacacacgcacctgcttccctttcagacaagaggcccctgcccctgctcctcatcggccctccgtgccagcagacgctgagattccacctccatctcccacccctttctgtcaatggccttctactgctctgatctttctaaccccgtaaggcacttttcctctcagatctccactttggtactgatttctgaagctgttatattttgtaaagaaattggtaaggttcttttgtatcacttaactcttgccacaatatttccgggtaacaaatcacccagaagcaggtgacttacaagaaccatcactttttcccactgtggcccagaaaagtgtgctcccaaatctcaggacccagatcctgggggctgactcccgagccgctggcagccccccattcccacactgctttcagcatgctgttgaaaaccttccttgcatttaaagtcctgattctgactgtatgtgcaggtgggaggagatagtgaggtgtctggggtttatctaagccaggctttcagcaggaaattgagcttctgttatttctgtgatggtagtttctacctaaatcaattacaactccaagtcagagagcacccactcagactgggtctggtgagggtatttattgagccatttagtgagcgggttgagcacacctctggccttggacgtggtgttatttcagggttagcggtgcattaggagccagctccggttctcctaaccacccctcctctcagcaccagcctgccactgcggccgctctgtgcctggtgccagcaggggctgcagtgccccagacagcatggaaggagagctgcttgcaactctcagaagacaaaggatggggcttctcagaagccccagcaaccaccagtgtgtccttctgccatctctgcgtccactgctgtggtcagggtgtggtccatttagactatcaggctccagtctgagctcagagtgatcagtgccactcaacctgcatgactaagaacgtagtcttcagtgtttcactgaatgtgagaatgagcactcacccgaacacattccacgccagttgggagataagtgatgagaaataccagtgcggaagtatctccgggtggggctgttggggcaggcgtatggggagcatgtgtggggtggcctccgccagaaggctgcaccccagcagagagccgagggatggaagggctcattgtggcttggggggggggtcagagaagtaaggaggagccaccagcaagggacccctgagggaggaagcccctagaggaggaagcccaaagagtcccgggcgaggccccctaccccccgtcccagcccgtcccctccatgacagctttgccctcatctgtcccagcctgtcctctccatgacagcttctcttgctgtctgctggcataggcaggacttcttcagctactgtcctaatgcaggctgtacacatgcggccccactccttcccaggatagtcctgtgtggcaaggacaacccctgctcccacttcacagatcagcctcttgtccagaggagcgggtgacggacccaggcccccctcagacttgagcactgtgggctgtaagctggtgctctgcatcctctctgccactctgaatcccttcttgctctgaccctgttttggatccatgtcctttgatgaggctttgcctgggtccagcgtgcacaggccacgttggggctcttgtgcccaaaggagggctcaattcagtccagaacagggtggccaaaccccctgacctctgctgcatgtgttggagacgcctggcaggttgaagcaccaggctattggtaaggcacctgcagtctctgaccctacaggaatctgtttgtcttctctgccacagacaaaaccaagagagtggcatcaaagagtctgtctcctggggcactcaaaggacccaggatgcaccccatgaggccaggccacccctggagcgtggccactccacagagatccctgtggggcggtcaggagcactggtgagcactcccgggggctagtgagactgggttgggggatgtgtgaacagggatgggggatgtttgagactggggtgggggacgtgtgaacagggatgggggattttgagactggggtggggaacatgtgagacttgggtgggggacgtgtgagactggggtgggggatgtgtgagaccagggtgggggacgtgtgagactggggtgggggatgtgtgaacagggatggggggtgtgtgagactgggatgggggattttgagactggggtgggggacgtgtgagactggggtggggaacatgtgagactagggtgggggacatgtgagacttgggtgggggatgtgtgagaccagggtgggggacgtgtgagactggggtgggggatatgtgaacagggatggggggtgtgtgagactggggtgggggacgtgtgaacagcagtgggagttaggtgagactgagatggatttgggtgagaccccagtgcctcatggagtgagtccggggtgggatcagatgagtccgcggtgccttgtgtggtgggactaggtgagtgctgtatccacaggctgtggacgttcagatgcagagcataacccggaggggccctgatggggagccccagcctgggctggagagccagggtcgagcggcctccatgccccgccttgcggccgagactcaggtaggtggtctgggagggtccaggccctgggctgggcaagtggggggtggggaagtggggctgtggctctgggcctcctgcaggtgaggagagctggggtagagaggctggggtccatgtgtggagctctttgctgaggcaggagcaggcaccccgggcagtcctgtctgggcgccgacagaggtgcagcctggacgccttcagcccctgaggcttctccagagggtgggtcaggtccggtagaggacagctgtgcctgttctcagcctcctattaggggccatggggcataggggcccccactctggctcagccacgttctgttcctcctttccggggctctactccctgagacaacccccactctcatccagaaaatttcaccgacacctcagtcccctctcccgcccgtggttctgcggaggaccctccctgctcatgggcagtccctggactacttttctacccagctccttgctgggctcgcctctttctgggacatgcacactggattcaggaagaggaagctctggccccatgtgtttcccgggggaggctccttccacaaggacactgggaggatcgcccctccgaggccaatctgggaacactgtgccccggcctccgaggcctcggaggagctgcagggcctcacctgcaacatgagcctgcttcagttggccaaaagtgaccggagcccccgtgccagccctgtccctcggccgacctgggctgtggagctgtggatctgaacctcgtccgtggctcgtctcccatcccactgctgtggccagcaaacccttttcctctcctcactgcctctcctccctcttagggttttctcctcttcccacctgtccttcctctcttgtctctttccccgcccagtggtaccctcctgggtgctgcctggtgggtgggtgcaggctgagcctccctgcagcctgtgctggggcctcctccttcacacacgtgatgcattggcggctgtgggtgagtttacctgggagggcctacccgtcccaggtgtcttcacgggtcctgattctggccgtggaagcagctcgggagccagtccaccccagacgcaccaggcagagtgatcccattgcagccagcagaggcgtctctggtttccactcagggttcttccaaccaagccagccacctctctcttcctggcacgacacatgggatggggcggggactcaggcactgtctgcccccagcctgccctcctgggctaccatttcaggcctgggtccttctgactgtgagaccaggatggggggcgtgtgggcctgctgtctggcctgctccaccacccacttccatgcctgcattcccgctgaccctggtgcctcccctaggcccactctcagtcctttgcccacagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcggtgcgtgcggaggggcccggggagtccttcggggagctatggcccgagtcagggggtccaagcggcccatgggggaccctcttcctttgtgggcctcgtgaccccataaccagccagagcagggtgggactgaggcccaggccctaaccctcaccctagcctcccctggcaccacctgaattctgtcctgctgggcccgggggtcaggggtccctgccttgggcctggccgtgctaacttcttctcttccctggccagcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggtaagaggaataggtggagaggtcagggcccagctgcctctcctcggcccagcacccctgtcccacaggctcctgcctctccccagggcctcgctgctgccctttgtcattcccagcaacccaagggccgggcgctcccctctgtgccctgtcccggagcccacgtctgcagcctaccccagctgtgttctcatcaagctcctgcctgggtcaccctgggacagtggttctgcgtcctatccactttcggacctgggcccccaaatacttacctctctctcggtcacttaactctccttccctgactgtggtcgttgggcttttgttctgtccttttccctggccccagcctgtcccttcccatcacctgctctccccaaccccattcctgggcctgaccctgaccatcgccctcccccgcacacaggtgcctgttgcctccctggtcaccgcagcccgttgtcccccattgcctccctctctcctcccatccccccaggcacctgtgtgtgatgtgctctgtctgttggttcggcttttttttttttttttttacctctgatttgttctggtccattttcatgtagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 816 - DNA, 246837 bp, Homo sapiens; identical to SEQ ID NO: 815

SEQ ID NO: 817 - DNA, 294008 bp, Homo sapiens
atccaattaaaatgatgaaaatctttaatttttatttagttatacttgtacggacacgtgtatatacaaatacagatcgtatgggtttgtttgtgtgtgggttttttttttttacattttcttttacgtttatataatgtcagcatttcaaaacagcactcgatgagtaagtgcaaaggaactgcaaagcagggcagtacaagcacaggaccacacggagctggacttcacacccagacgcacacacaatgagtggcttcaatggggtgtcaagagtaagcatggagagcggattttgactcatgggtaacctccgacatgccagcatctattaaactgtacagacaatgggagcaagcccattgtagggagatttgtctcacatcctagcagccctggggccaatgcatgggaaaaactcagtgatgccaaaccagagacagacctgcccattcacagctctgaggggaaataaaacgtgggaggaaggcaagagacacacaaaaaataaacatactaagtaaaaggggggtggtgtaggcaaacgggggtgttggtggaggcggttttcaaaagaaaagtcagtgaccacaactctgagagcaatgaatggaaaggaggagttgaaaactgtttttctaattatttgaaaataatacaaatggctgctgccgttgctaaggcaccggagaaaaacagagtccctgaaaatccacaggtactgtgtgactcttcctttcacaacgacacagagagggaaacagccccatttaagcttcctacactgattggtttgcaaccatttccatgagtgagctgcacatgatattgataaagactcttcctgggaaaaaataaaacagtccatgaaaacaatcacaaacagaaaaccaaaccaaaccaaagtacagaactgtttctaaattccctatccttttcaaaccaacatgctggtggagaagggagggtgggccacagggctccaacatcagaccttgaaaacaccgaggacaaaatatcgatcaaaaaagtcatgttgttccaggtcccaagatgatggagtcataagattgggtgggcaatgaccacacatgagtcctgtatggagcagtgtctcagccacttgtgactctttttttcagccatggtacacattggatgtttcaaagcctcaatgcatgttttgtatcctgaaagtctattgttctcacttacaaaagacataagaatcaaattaatactttattatcaaacactatgtacaacagaggttgctaataatacagaatttaaagaacgcagttttttttttttttttaatgttttacttttctttcctctgccacccaagaaagtacagtacaaaacaatagtctaaactaacacgaactgttacctggtctattaaaggatacacggtatccactaaacagacagatccttatttccctgcttgatgttgcaaagcccttggcaaccaggggcaaaggtcactggggtttgactaactggggctgagtggcagctatgactgtccttcagatttttgagttgtttttgaaattaaaagcttctaaaagttgcatcaacatcctcctaagcccccagaggattgtaacaccaccacaaaaggccaccaacactttttaaacaaagtgaaaactgtctgacaccaatcatcttgaaaactccatggcaagtgcattagctatgatttcatcacttacaggtagagaagcttactgtctactggtgtggacactcttgctattttctttatacttaatttgcagtggcagaatggtgaagtaaaggggtctaatttcactgtgaaaaaatgaaagacaatggcagagagggccatgagtaattatttcaccatttgttagagacaaatgctaggaaaaccacagaagtcaccatttctaaaatgcatttagcactgctaacatagttatgactaactggaatcatgacaggatcatttgatttccttgtggttatagaacatgctgtattattttggttctattgatccattttagaaggtatctttctccccctacccaaatcccactggaccaacaagcctgtaactattaattaaaaaaaaaaaagtatttctgcatatgactgagagtactgcatatataaatagctaaaggaaaaaggaattgaatgccgtgaacttttgttttggtgaaatggtggctgccttctgtgataagactctgccactccagaggagttccttatgtcagaggggaataggattgattgtatctgtgaggctggcaaccccacacacatggttccatgtgagaacagactcggcagtgacatccactccaaatggatcaggtaagcccagattacatttcaacatgtgtacaactctccagggcacaatacgtttacagctgcctttccttcacatacttttctaattcagaactactcacaattctaagcaaattcccattcacgaagtctgtccataatgcgaccttctctttttttaacatatacatcttaaaaaacaaatatataaaaaattcttattttgctggaatgctttcaatttttcacattttacatgatcatcacatttatttcttatattgaaaggcatggtttctgttgacatgtcgtgcaaagccaaaaaaaaaaaaaaaaaaagggctggattgcttttcaattggtctaacacttttccttgtctaggctttggattttaaagttcatgacagccccaccaccagtagaaaccccaaggcttgcatttcctggtaatcgactggaaacgtcccctgttggccatgctaagattccttcaacagggtcatcctgcatttattctccttctgccccacccccacaatgaaacaagatagcccccatatttctaaatgtatcaagggataccactttttctcacaagtttaaataggacaagcatatatactcactctcagcataaagtatatctaaataatgtattttctattctagtggatttttaaaaaaatattttgttaaagtctttgggactccatcttgtttatctcccacagataaacacatgttccccctacgctttaggctgtgtcagaaagggaaagaatataaaatcaacacttgaatttttttactccaaactttggaattttatttccaaatttccctttagccctcccaagtagtgctgactgactctcctggtgacaggggtttgtgtccgagcccctgcggtcaaggagtgtggagcaaaacgtgggtactagggtgggaggcggggaaaggccacagcacactggcgctccagcaaagccaaatcatgtctcctctggccactgcggtcctctccttggtacatgtcatcccccagaggagtatccaaagctattccactatgcactcatcaaccctggcttgtcagccttggggaaggtcactttattcataaaaatgcctctttgagtttcttaaaaaaaaaaaaaaaaaaaaaaaaaaaaaaaaaaaaagttgtagcaccatggtgatctgtattcaaagaaaaaatatctggtgtgcactgcccagtcaccaaaaaaattagaggcactcacacatacacacccccagcaaacctgtagttttctctgttttcacacctgctctgtattagcattccacacccaacctgcctcctagaaaaaaaaaaaaggcttcttttagagagcacaagttttgctgtcaagaatgctttaagacagtcatattaaaaaaaaaaaccagtgtctcaaccttttagaagcctgttcatttacatactcctataggaaatggtgtaatatcgtatctattcttaatacctcccctccggacctgacatggtgacatgatgccctgcgcgatcatcttacagttctgaatgagaaggcataaatattgcataggagagcaaaaccctcccagccctagccagcgctggctgcatctgccactattcttccttgtccatagcccgctgacacagtgcgctaacggaggtgagttcttagaggagaatgcacaggagctgacgaaccactggtgtcactatgacaatttggcattttcatctggagtccatttaatttgggaggggtgagagaagccaagggccagggctgggggtggggcggggtggggtgagggaggcaggaacaagtttaggcccccaacctgaagttgttgcttagaattcaggctgaaagaaagaaaacaaaaatctgacatctgccaaaacccaataacaagtcccttcttaggatgagcagttaggtggatctctggtgttccaagaccctgatgttttctgtgacaagtgatgggaggagactgtgctataatgtcaaaagcatcgccaggaggaacagtaggattgccaaaaggcggctgggtatccttggtgtttgtgccgcgttctcgccgcgggatggctcggctgactcatgtacggtgtcatctgttcaaatagaaagcacacattccaatgagatttcacatccttaataactctcttgcagcagcctgctgttaacagacctcgccaccctctgcaaagtagggtaatgaaccttgtgccaccattgactttcatgtctgcataatcactcattatttacagcaaacaaagaagaggcaaagaaaattggactttctcagcaatattaatactttccttaaaaattgaggggaaaaattatgcatacaccgtaacctttggcctgtgagctgctttggttagccagcagtcagacacgccttgcacaaatttcagatatctgaatgtacctttgaaacctaagatgtcacaggcaagcaagtgacatgttggtgggggtgggggaaggggcagttatgttggcacagtagtggttaaccagaatgcgctgcccatttcccttcttttagctgtttcataggattagtgttgaatgcctggttgttggatgcctagacgaattttcaaacatgaaaaactaaatgccaaaacagcagcattttggataaactatacatcatgcctagtaaacttcaataaacgtatgcccactagtttgcctgcaattaggtgtcaattatggtgctatttctattacaaaccctgtatttctaagattaaattacttgaacttgactatttttatttttatcgggctgaagcttggcacataaattatcagcgtggatgcaaattttcctctaaataaaatagattaagtgagttaagcttcttttatttagctataaagtgttctatgaggctgcctctgactttggatagccttcctgatctgcatgattaacaggcttaacttccaaatgggaactctgaagcaattagtaccaaagagaggttggaggcttgcctaggagccaagctctgctccagggctgcctgtcttcttctttccacctgacctaacttatgcttttatttacttttaattaagttaaattaattaatatttttttagaggtaaggtcttgctctgttgctcaggctggagtacagtggcccaatcatagctcactatagtcttgacctcctgggctcaagcaatcctcctgcctcaacctcccgagtagctgggactccaggtgtgaaccacgatgcctggctaattttaagaatttttagagagacagggttttcctttgcttcccaggctagtctcaaactcagcctcaaccaacttcctcccttggcctcccaaaggattgggattatagacatgagccactatacctggccacttgtgcttttagactaaggatctctgaataacacattttgggggccaatagtgagcccctgtgcaaattttatctcagcatcagggtaacttcctgcaggtgttcagcagttgccatctgggaattgctcaagggccagacagaatggtaacaaggctctagtggttgttctcaattatactgacctcaaaggataatccctaaatacccctggatgacccacctcaaaccccttaatgggttaactaaccattattttaaactcatttgtattttcctaccacacgtgtcacaataagggtgcttttccttcactgggtagaatcacactcgctaatatttgtcctaaagtaaccacttttcaggttcacaggctgacccctgcttcagatatgctcgtttgggatggttttgtccatcacatccattcccaatgagaaaggtcttctcagtgttgagtctcctgacctggagtgctcttaccattttagcctcccctcgaataaaagctactgcatccccttgtcaaatgtgctcccctttcctggaccttagcgaatctgcatggagtgattttagcttaggagactagaaaaggttaggaagcaagatggtaagataaatggatgcagaaaaaatatatataaagtcctccacaatgtggccaagtaccttcagaccctcttctattctctgctctttttcagccttgcaagtgtattaattaaatctgtagttaataggaagtagaagtaaaggcccttaatagccctgaaattaaaatccaaatcactttcttaagagcaccaatatgttgtcaatcaaaacaatggagcacttcaggcttaactgtgaaataaccacaaaccctgaggattccagagttcatttcacaatatcacatacttaaacacctgaaattgcatcagctattggattcctctccatcttatttttactagcatattacccaatccttctccttgtatagcttgcaagtgtactgttaaaggtacccagctagcacttagatcttcggtgtgaaccccttcatcaccaccctagtcccttctaggtactcagtgagggctatccattattccaggtccactcagcacaagacacaaggaatagatcttacaaggtaatggagaggaaggcttttgtttttcatctaagtgaagtatgaggctaagtgtgactttcagtcctttaaccatacacaatctttggaattaaccttttataagcacccaacgaatatatatcttcctgccccccaaaaggaaatcagtcccattagggcatcaggatccttctcttcttcctgcaacatgctgttcctcattcaggattccacaaagcatcctttgattaaaacaggttctcaatgttggaagattctacagcccccaaatgtgaaatgagaaactggctgtcatttgggtaaatctgagcaatttcagaattctaaggaggaattcataggtaaaatctatcccaatggaaactacacctaaacatgagagaatttctaacgcttgtaacacaggcttggaagaagaaagaaaacgttcctcttcagaagtcaaatcaagttttgcctcctggctacaggattccacaacatgggggtttcaatggttaacggagagaacactagcgatattttggagcatgttatgtggcatatgtctgccctgagatcatcctgcatccctgatgataggaaactggcaggcagagtgtgcaagcaaacaaaaaagacaaatacattccaaagacaggtgaattagtacacatcgctgagatcatgcagtggaatcctttcagacttgctgggttcataaagactgggtctacacccagagctggggaaaggtaaataccctttcactcagtggctcgacacagtggtgaagaactgcaaatccaactagactttctctctcttcttagagacagaatcttgctctgtcacccaggatggagcacagtggcgtgatcatagctcactgtagcctcgaactcctgggcttaagcaatcctcccacttcagtctcccaagtaactgagactaaaggcacacacaccacatttttttttttttttttttttttttggtaaagacaaggtttcacagtgttgtccaggttggtctcaaactcttagcctcaagcaatccacccatctcagcctctcaaattgctgggattataggtgtgaggcacagtgcctcacacctgtaagaaacacatttcttattgttttcttattgccaggaattgtggttcaaccttgtctcactttgttagtgaagatactcaccagcaagcccttaaaatatagctctgactgactcaaggagcttttcctgcatgtacacctacgctctactccccagcacacgtatgcacacactgaactacattctgccaaacttttgcaaacttccagcagttatatgtccatcaattttgggccattgtgcattttaaatgcttagtgaaaaaaaaccttgtttccccaaagacagtggtatatgttcatgtatgaaagcatctcaatatcttgcattgtatcgttagtggaattcaaaggtaattttcctaatggcagaatagtcctccatgtgcctcttcattaccagagaaaaatatgcaatctgttaggtgtctaagcagcctcctatgctatagacaggcagtggagattccctggaaaaaaaaccatgggaaagatatgcctacattctgcacaatgtgtatcaagagatcataatcctgggtaatttttgtttagaacatgctggtcattcttctcgtggcttcttaacaaagacaagagacttaagtcctctttatgaacatacctctaataatggtaagagaccactactttgatactaatgttggaataggagtcagaagatctgagtattaaacctggatctacctaatcagcaatgtggcatgggtgagtctcctcagccatagaaggaagagtgtagagtctggggttgttaagggagatactgagtaacttgcagatcctctggtggcccaagtccctgagcttgtgaggactctggtaccttaagaagccaaagtcatggctccagatttccaggacacaattaaaatgccttcatgtcagcattcattccttaaaactttctaaagcagctaactgatccctggggagccactaagacctcggagagctcattgtacacacctctcatttgcgctctgggtgagatgcctgccttagaaaacaagaatgcttcagggaaaaaactctaactcttcctgtcagttttaacaggaaagctattgtatgtcctgaggcacagcatttactcagggtaagtttccctaaggttcattgactatgcagtcctggttacaatattggaggaaaaagtggaccttaatgtccgttagtttctaggaccataaggaagagaaattctacaaaaaaaaaaaaaaaaaaaaaaattctccatttacataagggggctcaaatctctccatgaagaggaaataattttatttcccttaagctttgagatgatcaagggagatgggtaaggaaaccagtgaagatctggagcaggtcggggagaagaggacaccacagaggaaggaaacacacagggcctccaggcacacccctccataagcagttggtagagggcgaccactcctctcagttaatctagttttattaaatggccagactgaattgataaccgaatggatatttacaggttcttattatccatagtatgcgacagactaatgcctcaacgagtgctttggtaggttttatttttctttagttatgggaaacattaggagtgtggaagtcaatcgtagaaaagttttatttatccttaaaacttattttgcctcggtaatcaaggatcacatttggctcaacaggctactggtacatttgtggcacaagagatgtgcgaatttgtggtggcaatgtgattatacttctccagaccaattactattgacaatagcaaaaatatttaaataaaataaagttccttaggtcagttcaatgatgcatgtaaatttctagagaaaactaagtatgttgaattagtttctattttgtgcaatagtcttattacttttatctacagatttggacataaaaaataaaattttatgaacatatacatagaaatgttttgtgtcttacatgaaaacagatcctttaatattcacagtgattcaccagcatgctctgaggatatggtaaaaggcagtgagattttagcattccgatggggcttctatattaggatactgcattagctcaaacccattccaaaaaagaaaattttattttacctaacatgcattgcacaaagatactggaggaatgaggtagaatataagtcatattagcatcgctagcaatgagcaaaagcagaacaacaactataacatgcaaacatgcagagaagaagaaaggaaaaaaatacggaagcaccagagaaatagatgcatttgttaaaagagattctctaagcatactaacctgctggttctaatgaattttctactttgtcgttaacatcgaaaacacgatcatgaacacctatagttttcatacagctatctataacaaaaatagagataacagccaaatatgttagtgaagacacccttaaactcccatttctttcttttttctttctctcctttttttctttttttatgtagattgtcttacaatcaatggcatgttccaaatgccaatattgttcccatttgctctgcatgtacaacagtctaagaaacaacaagttagcaactgctgtgtacttaagtaaaagcatcatgaagaatgagaaaaaatatgatgaaaactaaaatatgaatgttgatatacaaaacagataccacacaagatttaacagtaaaaaaaagttttaccgccgtgaaccagaccacacaataaagcatgcgcggtgaagccaccctctgaagctcattctagtgaacttacttgttggtctcacaaagactttgagctttagacaggaccttcttccattatctgggattgcagaggctgtgggtaacacagagagagagcaggaaagaaagaagagaacaacaacatattactcttcattttcacatacaaatgatgaacaataaattctttcctgacttgaacaacaggaactttctctaattcctcctccaaattaaaacaaacagtacttttcaggtctcactgctatagaaaggctactttcatatcctgagtttctcttttcaatacaataaaagaatcatgcaagaatgtgagtaatctgtgaagaaatactttggatttttatttcaaagtctcttccatttaacttgatctgttatcaattttctctaaatcgagaggataatgtgtgagccctccagctttcacagagccgctcctcctctgctgcaggaaaaggggcccaacagaggcccaaggtgaaagtgccggcaaaaaccaataacagagagttacaaggcagacttaaacgtgacctatttctgctggggaaagcagagctttgtctgtactgaaagcttgtctgtcagtgcttttgcaggtaattcaattagaggttttactcagaacttggctctgcattctatatgactaacccaagcccggtaacttccatcatgctattataagtacaatatgctattgagaaagtactatgttgcaacggtacatgtattttttttttcaatttgccacagagaaggatggaattaataaagtgggcttaccaaaacatgacagcatgtttcaagttataaatcacttgaggaagaaactttcttctccttttcaagataataagactgtaaactttccctatggttgaaagattatctcccctgtgtacacacagcaaaatgtcaaaggaatttccaagggcagtaaggcccttaacaaccacatgtatttactaatgcatcctagaaatgacaaaaattacagaaacgagcgtcgcatactttcctccctatgtgtttgcttcaagtggtttctttgttcagaaaaagcagatgacatcaatcaaatcacacatggcttacaattagtttggcaatacccaaagtgacaaagagggatcggcatttggtgtgtcttctctctcctttatttttatttttaaattattcctcatggggagctgagaacacaaaaatgcttcttttgcaggtgagaggattcaatatacaaacttccaaacaaattttacacagtctccttatgtaattctagatccaagtaaccctcctggaggagaacttctaaattcaccaactaaataatgtcaagtagtatagggtccccagtgtccctattcaacacctgttgaaaactactttaattttaaaacaaaagtgtagagaaaaagtgtttttggtcctccctatctcccctggttgctctgacaagcagttaagaagtgctaacagctggctttgctgtaggctttcattaaatcatagccagaaaaactccctctactgacatttacagtaactagtgtgttatttagggcacaatatttgcactctgcggtttgatccaggaaatggtgtccttcctgtggacctcaactgcaaatgtgcatgtcacaaatacagtacacataggtgactccaattcattaggaaaaccacgggttcctgagggagtatatgtcttattcatgagagttagtgtgaaaaaagtgacacatggatgttcacactgctgttcaatgaatttctgagctgagatgaactcacttcaagccttgtgaacttgatttgctacatgcacataactgactttacagatgatactgctagataaacaggctgaagacagaatcaaatgcttaattggtttagcgaggagcttcttggatttagtacaggtctttcagatttttctttaggagaaataaatccaggacatgaaaattattgtagggcacatggcaataactaaacagcaaacgatacgcctccaggaaaaaactggagagttctctccatgagctctcaaggagggacacagtcttagctactggatgtgctccatacttctgtgaattaaaaatatgaaatacatttgtatttaaatgacacataaaataaaaacctctcttccctaacaacctgccccactacttcctcattttctgtcaccaggaaatgtgactgatgccttgtgatactgtgactattatactctaatccttagaaaaatttgtgaacaaagaatattagcacacaatgtgatatgtgagtacacaacacagattgcatgccatggattcactcgatcatcactgcatcactggcctgagctcaaggagtaaactcctaacccttacagccaacctgagaagtgtgccttactaggtcagtataacttgggtttcttatttaacaccttgaaaaacaaacaaacaaaaaaatccaaaaagatgaaaacgttttccatgtagtagcaaaactccattttttaaatgtaacgtttaataaagttaaagtgtggctttcctctatgttatgctcaaggttctgtcaccccacacttcttggctgacaaatgtaggatgcctttataccaactaaaaaatacagataattaattattagtactatttgaagacataaggtaatataaaagtgcattactaatcacaagtaaacaaaaggcagaggactgagcactaaaaacaaaacataacagaggaattgaaacatgtaacattcccactaataaacttataaagaaaatctcaggatcaatttatgagcaatagatagagctgaggatggaaatgagggagtaaaatcttaaaacatgcctcgtttttgtcaggaggtaggtagtattaatccttatggctctagagatacatcactttgtcatggccaactttatcttagttaaaagtaaatatgtaagtattttatacataaattatatacataaatatatataaatttatatacataaattatattcactatatataacttcttgtgctgctttccttagaaaatgaatagtcgatgttgaaagttgataacgaataattataaaaatccattacatattactgcagcttcatctatcatttcaaatgcttttaaaatgcctactatgggttgggtgcagtggctcatgcctgcaatcccaacactgtgggaggccaagccggatggatcacttaaggccaggagttcgagaccagcctggccaacttggcaaaaccctgtctctacgaaaaatgcaaaaattagctgggcatggtggcacacacttgtaatcccagctactcgggaggctaatgcatgagaattgcttgagcccaggaggcagaggttgcagtgagccgagactgagctactgtactccagcttagcaacagagctagactctgtatcaaaaataaataaataaaataaaatgcctactatgcatcagcttctttattaggtgctgtgcatgcgaagatatataagatttcaaactgtccctgcccttgtgttgtggttcttcaagctgggacataaatatgaaccacagtttagcgtacctggagggatccatgtgacaactgaggtttacatgaagagccagcacagctctgggcagggagcaagagtgtgtcccagacatgtttatcagaggcttcacaggtcctccagaagctaaccagcagcaactgggacagaagacattttatccctaaatttccaaaccagagctttggcaaccaaaaagaggcagtgacttgcaaacaggtgaaaaaaaaatctagatctgaaatcttcctctaaagacacatggattttctaatagaatttttcaactaaaatgagaaatgtcttaaaacagttgtcacatcatccaaattcacacccatttactcagtttactgcttaaagtgtaagttggagtcaggaagttgggagtagggatatggggacaattaaaacaagcacaatgtcccattccattatcttaatagcaactttataaatcaatccatagagtcccttcccctgaatgagctgcaacgtaccaatcaaaaccttttaacacataatgaaatacaagctggagactctctggttctctgtgtttcgagtactctgctaataaggccatgagggccccttacttttactctgttccatgacctcagacaggggctctaacttgagccttcccaaaaatcttggtctcctggggctcaggtgagcatgactcagcacttagccaacttggtatagaaaatgacgatattcagtgcccccaaatcagtacttctaaaagttatatttagcaatgcaaatatatgtaacattcataccacaattcaccatagatctatcattcagacatagtagagaacacatcccttcgggtactgccatcatgcttgtggcgggcagcttctgacatgggtcccaggtatccccacattcctgtaggcagtcctttgtataatcccctccccttgagaggcgactgaacctattaacttgcttctaaagagtagaacatggcaaaagtgatgggatgtcattctgattgttacaaaagactgtaccttacttctagtgaacactctctcttttgctcatgaagcaaggtaccatattgtgagatttccaatggagaggaccatgtagcaagaaactaacagagacttccagccaagaggtacaaggaactgatgtcatagttcaacaacccacaaagaactgaattggctaacaatcgggtgagtgagctgcaaagtgaatccttctcactgagccttgagatgaccgttgccttgggagagactcaaaggatccagctaagctgcacctggattcctggtccacggaaactgtgaaataataaacgttgttttagccacaaaatttgggggtaatttcttaagagctgatacaatgctgtacactaacaaatctgtgtagttaaaggcttaaagctgacttcggactgaaggactaagacactctggcatgttctgctaatggccagcatgcccttgctcccacagagctgtgcactcctgattctgctgccatgcctcaacaactggatcccttactagtttacatttcaagctactgttacaagtccacttaaaatatgccttgaagagaggtaattataagctgctgttgaagaaatacaacaagacatatcaatttaaatgttctcactccagtattaaaaagtgtttttcattttccttcgcatacaacttagtttgcttttgctaatgcagccaacctgtgctgttctttgcaattagcatgatgtctcattttaactacaaattgctgggtaaaccaaaatgagttgatacaaaatgtgaacataaatcttaaggagaatgcctttcttcaaataggagaaatagaatggaaaggtggtctttaaaaatacctgaaatgaaaggattttaaaataagttaaaacttttcttactaccaaaaaactcctattagttatcttctacacaggccatcaagttaaatacaaagattatgagacttcaaacaactcaaaagttccctaatcatcaaggtaacaaccattcttcttcatgaagaaccaaagttttagcagaaaaggaaggaaatattgttttctttcacattttcaggcccaacactgtactcattagtcaaacttaacatctctgcctaaccttattcagcttcaaatcttaattctgaaagccaaaatcctccttttctgtgtcccatgtcaatctgggtactttgggaagttttatttttaagaatattcagccgctttcttctttttaaagaaatgagtgtgtgggggagcgttaaaaatgcagttttccattatgtttgccacaggcaatatttctcaattcgtgcaagtcaaaagaaaagataggctattagctgttagcacggcccagtttttttccctgtaggtttttcatgcagttcaacatacaacacaaatatatgcaaattaggcaggtgaaggtggaattaagcattaatattcctttcacaataaatgctgaaagagtaaagcccatttaaatccatggtactactggaaatatctcctagaatttgatgaatcaataaaatccagtttgtgtacatgagtggagtggggaaacagaagaagtggtgggaacagaatagagattaatcaaagccatatggacttggaaaatggttaccagatccacagaaaacttgttaaaacaaaagttaggcctcttcttagggaagaatactaaagcaacaatttgcaactggctatgtgccccttttttaaaagcattttcatacaaagcattttcatataaagaacaaaatcatgtgttatgatgaaatacatctcactcattctaacttttgggatttaaaagtcatgtgctttaatgactcgctcatggccccggtttaccaagcttgcattcatggtgccaccccaggagctactaaatttgccaacacatttcttctcttgcagcccactgcgtctcaagacttaaatcatgggcaggttaaggtcagagcccaagacgtaaaatttggaaaggaggtcactaagtaaagatagaggccttggagaaataagaatatcatgtaaatattagaaactttgatatgactctggggatgtttcttttaaaaaccagaataagaaaagggatgtgtttcccaccacataacaagagggatagaaaaacatattctgcaagttaaaacttggttttaacaccagggaactgtaacaaggaaaaaataattagagtaaacttcaggacaagggaggtaaaataagttccagctgtgcagccacacacaaaagagaaatgggaagcaccacccatcctacccactgtttgccttccctcctatctctctgcccccttaaggcaaagttctcactgctaataactaacctgagtattatttaaattccagcaggtaagtctcagtagatcaattactttttcttagccacctcaagtaaatggctgaggacaagtttccactcatttctaggaatactccaatagcacactaacatgctttttgtatatatttatctgaagtatgagcaaacttttacttgcgtttaaaagctcagtgacaacaaactttgtttctgctgcttattgaagaaggggatgatttgtctcatatagtttgatatctatttaggtatgagccaaaaataacgtggattttggagaatgattttaaaatgtccccttataagaaggatttctagttcttttttttttttttttttccgcgagacagtgtctcattctgtcgcccaggctggagtgcagtggtgtaatctcagctcactgcaacttccacctaccaggttcaagcgattctcctgtctcagcctcctgagtagctgggattacaagtgcatgccaacatgcctggctaatttttgtacttttagtagaaacggggtttcaccatgttggccaggctggtctcgaacttctgacctcaagtgatccccctgcctcagcctgccaaagtgctgagattacaggtgtgagccaccatgcctggcccatttctagttctgcctaaggaaaatttaagacagctttaaataaatctcacattctgaatgtaaacttcacctctgtcagtcatgtgagtggggaaatctagtcctcacaggcacagaaagcaagataatatttagatatcattttaattgtctaagaaatttcttaacatgaagaaatatagttcagtttcttatatattttactatttttaaaaatcaatgaacatctttgaacagttaagaaaaagttttctattatcaactagtgttctaactattctctgagacctcgccttgcctaaggccacacaatatttaagtgactttctcaggctttaaggtcagccagttctttctttcttgtttgtggttattttggtgaacttactgtactagagaggtattatctgacaaaacaaaacaagacaaaaacagcaacaaaccagataggcagaattattcacttagaaaacctcttcttcagatggaagccccataataaccataataacaacaaaaacaaaaactccaacaaaaggcagaattcctagaatcccacaagaggaactatttatattatttcttctccacaggctccctttgcccctctgtgtgataccctatgagggtggctgttaaccgttaggcaaggaaagcaaagccacaaatcccattcctcattcgtaagatattaacagaaacaatgtcattatcagacagcactaatgtagcatgacagtaaattactaataaatcatcaagttaatacaattcaaagaagctcctagaaaaaagttaatatttctgtgagcctttcaaaacccctttcattattattctccttggtgagggctcttttaagaaacattacttagcggtttgagtgtatgcataatgattctctttctccctggttcattctttttgacttattttgtggttttgagccagctgcttaacgtgcctacgcctcagttttctcattagcttcatcttctctaaaacaaattttaagtatgacctgttttagaggggcagtacaattttataatgcacttagaaactcaggtgatccctacagatctagaatattgtttcactattctacagattgatagcatcagctctgcgcttactggggcctctgcatggggatatccctaagcagggggcacccagctgagggcttctgaggttgtgagttctgagtgcaaatatggaggaggaagggctcaggtgtggatagtggtgattaaaagttacttaggagtcataagaaaaacaagggtaattaagtgtgatcttctctagcataaattttaaaaactggattctaccatagtttgacttgttattttgtgtgtgttggagggtgggggtggtgatgaagatatttatgtgaggatgtgcactgaggctgagagaatttagagaattagggtgctggaagatcctgttccttttgaaaatatgttaagatctctgagctcttttttcaatccatgttaagagtgtgagcagtgagcatgctattaggctagagggaccgtaggacaaggatgtaaatcctgcagagaggaaactaggctgggtgttgagactgcttttgcaactgtatacccagacatgacagtgatgacactaaaggaaaccagcccagaggtggctatagatcccgcaccatgcccataccagtccatggatattgtgctgctatatataaatgttctcactccactctttaatttttttttttgtatactatttgggttagcctggtgcaatgcctatagtcccaactactagggaggctgaggtaggaggatcacctgagcccaggactgaggctgcagtgagctatgattgtgccagtgcactccagccctgtcggcagggtgagaccctgtctctaataagaaaacaaaacaggctgggcgtggtggctcatgcctgtaatcccaacactttgggaggccgaggcaggtggatcactaggtctggagttcaacaccagccttgccaagatggtgaaatcccacctctactaaaaatacaaaaattggtggggcgtggtggcaggcgcctgtaatcccagctactcaggaggctgaggcagagaattgtttgaacctgggaggcgaaggttgcagtgagcaaagatcacgccactgcactctagtctgggtgacagagtgagactccatctcaaaaaaaaaaagggtgggggtaattatctattttatttacacaaatcaatgatttctttggttgtatttcttaaccagtaagccatgttctccccaatgcctatcatttctggtgatattacaagtatctagatagaaatatccattcatttaggctggaggctctccaaatggaatcctagaggcctgaacaaattaacgttctctctgtagaagatgaaattttaccaaggagggagtcgttagataccaggattgtacattttgtttcacactcaaaatgctttccatgataaggcttttatgttgattgagtggagaaaaggacagccaatctcagggactaaattctagtttactctgattgtctctgagacggattatctgcagaaaagttaatggctgtgcattcccattcgtcataccacagaacagcagccagggtttccttttccataatctggtcccaaccttattctcctttgttttgtttgtttgttttttgagacacggtctctctctgtggcccaggctggaatgcaggggtgcaatcagggcttactgcagcctcaacttcccaggctccctctttatccctcctactcttttcccttctttggcatacattcatagcttgtaccaacaatattccctcctagaatctcctggaaagtccaccttttctcatgtgacctttcctttgcctctcaaaatccctacttcctctggccacttgaggtatgtctccatttctccaacacaataaccctcttccaggttcccacagagatctgtttctgtctccttactagcacttaacccattctgttttgttttagaactggttaatacatcttatctctgctactagagttgcaaattcccccaaaggcaggagccatgccaagttgttgtgttcttgggttctaggttctggggagtctattgctttgttcctaacaggtgtttaataaagatttgaagaattattgtagggatttaaaaaaaatctgtcgaggccaggcacagtggctcacatctgtaatcccagcattcgggaaggctgagacaggaggactgcttgagcccgagagtttgagaacagcctgggcaacgtggcaagaccctgtctctatataaaaaaaaattttttttttattggccaggtgtggtgatgtgtacctatgttcccagcaacttgggaggctgaggcaggagaatggcttgagcccaggaggtcaaagctgcagtgagccgtgtctgtaccactgcactccagcctgggtgacagaatgagacactgcctcaaaaaaaaaaaaaaaaaaaaaatcttctagctgcaacgtgatttgttgacctaatatgaaccaaaatttaggattaggacacaaaagtgaagagaggggtagtggtaaatgtcaaagaaattaagaaaacaaaaaaggtccttgtccgagaactagaagtctcccctgcccacactgctggctccttcttgtagaatgatcttgggaactgatgtaataatcaggcaaagccagggatatacaaaattcaagtaggtagcatttcaatatctgtaagagtgtggggtcccaagaagtaagaaataagtgaaaggaggccaggcgtggtggctcacgcctgtaatcccagcagtttaggaggccaaggcgggcagatcacctgagggtcagaagtttgagaccagcctggccaacatggcaaaaccccatctctactaaagaaggaaggaaggaaggaaggaaacggaaaggaaaggaaaggaaaggaaaggaaaggaaaggaaaggaaaggaaggagggaggaaggaaggaaggaaagaagagagagagaaggaaggaaggagagagagagagagaaaggaatgggaacgtgggcatctttagatccaaagatatgtagaatttaatcaaatgatagcttgggtacaggttgcaggcccctcccagtgaacagagaataaaagcaaagtgagattagaatccaagtgaccatgggcttctttaagtaatgataaaaggtggctctggacaatcatgatcacaggtaagggtgacattgtccttgctgaattcctctaatcatgaagatcagagaaacctctcagcaagttaaagcacctcagatgttacatgagaacataaccccccaaactgtgctgagggatacaactatctttcaaccacagcagagcttaaaagaggcattttttaaagaatcaaaaccatagaacgagtatttcttgtgtattaaaaaatgccacctgtgaatgtggtactttaatacttttaaactgtgggataactttggccaacttgagtaaccggtcagacaagcaattctaatttaaaatatataatggaaaaatcgacttagatttgtgactaagtgaaattttagcagtgatgaaacctataatttacgtgtacagttttggaacatttaagagaactaaaggttcatcatattttaaaatttaatttattatagtaagaattactgaaataagtttttacagtcagacaactaaaatatttttaaatgatagagaataactaaatctaagttcagcttaaaatgttttaaagtctatttaattcaccaaggttttaaatgaatccaaatatttacatttgctagccttatatatagaataaaacatataagctaatctgaataggctaaatttgaaatttttagaaagatttaaaaaaatgtataacttcaataagtcaaatatcaaattttaagcgtaaaatttaaataaacattttacagataaaacccacccttctgtgtatcaaaaactcatcctgacacttcctttcaggtcctggattacatgctgcctcctcagagaagcctcctatgaccacctaatcgaaagctatctccatgtttctctggcactgcatccagctccctactagtataactgacagttatagatttgtttgtttcctggtttattgtctacttcctgatgaagctgtaagctccagaagcaggaaccattctttaatatatcacagtgtttctaaaatctaacatagtgcttggcacaaaggaggtacccaagaaacactttggtaggagtgaataagcgaatgaacagaaaactgaattagccagaaatattcaaggttatatattacaaaaaataaccaaaggcagcaaggtgttccagaaacttgagatcttcacagattgatttgctatgtttttcactctctgtgaatattaccttttatatttcctcttgctaatgcacagagcaatctcatagctagctagatgaaaactttgcctactttattactgctgcaagcttattgagagatttgtttactatttgattttcccagaaaccttagtttagcaatcagacaatgcacagatggataacaaaagattgataaattacaattataactttaacatgtagtatagtaaataaatcaatgatgcatttttaggagcttctagcatatgaaaagcctgcagaatggaaaaaaggataaccatcctttaacattttgtttctatttcttaagaaatttctgcagctaacatataaaaacaagtattctatccattagccatgatagtaataccgatgtgctacttaagttttaaggaatcatttatatttctatgctgactccacatgtcacacaaataggaagatttattgtattacttggcattttgaggaaaaaatcaatctattttgccgctgcttagtggaagaaaactcttgggtcaacttatctttttaatctaagaggtctcaattgaaattggctttgaagtttgctaattacaaaactcaacaggggttttcccttatttggtgtaactcatatttctattcattaaccccagttttaaaaagattaaaaaagtctgaatagaaacaacttaaaagtttgaagaacagcctctcccctgtgatacctttacagatacttcaagtgcaaacttcccccatactatcaaattctatttaattacaaatcttctgtggttgcaggagggggaggtaaaacacatacattttgaactttccaaccacacagggctgtaggaagatgagaaatcagtaaattcttttcactctatatattggggaaatttatgtcaacctgagttacaaggaaatcaagattctgaagggcaatcctgctagctgcttttgcagggccaagccactgggttcagatgctttcattcgggtgaaaagatcattaccaggcggctccggggaagttggccctcctgtaagtgtgctcctttgttatgaatatggaacagatggagccaaatctatctgctctgtaggaacaaaaacacttacaacccagctctctctattaaagactctacttagctcctttataccatcggctttctgtgcactgctgtgaggttttgactttatagaaaaaggcacttcataaaagcaacagttcttactcttaaaccaaagtggcctaagaactaaagaagatgaatacatggtttcaccgacaggactccttggagatatgtagatattcaattaggggtgtatgtgtgtgtaggaggaggaggaagactgtattcaattctggtaaatgtctgcattaaaacaacatgaaaatatagaaaagagcgatgaagatgtcatgtttctcattacaaggatggcatctaattgctctagcataataaaatggcaagatttaattgtgtatatatgtctgtaaggctagcgagggctgtcttgaacaaaaaatatgactatgcacaacaaaatcatgcaggtaaatatgattagtaattaggaccataccacaaaacaaaggctatatgatgcttcttcactatgaaaaataatattaattactttcagcatcatcatgccaatttgcttttacagtctgaaagatgtaaacactgcaggtaaaaccaatgcatgcatttatttatcatgccacaagaaatctacagccatccctacaacgtgctgttgccaagatatatgtgctgacagcaaggtaagtttcacaggcttccgggtgtggatacactactgtatacgcaccttccattgatagcaacagggggaaaggagtgtctgccttatttcattacatttattatactgatacatttaaagtctggctgcctcttcggagataattgaaaaaagaaattctgtggcaggatgctttgattctgactaaatcaagtcttcgggcaaatttcctcctgccagtggaagcacagcttgcctgaagtcgtaacctttgtgggaggaaaggaactggccttgaagcagatcatgaagcaaatgttttatgccaaatcagagtctggggatacgtaggctactgcaaataaaactcttcttctgtctgttcaatcatttcaattccctgcagtgtgaaatatgaacttgccaacaaatggccagcgtgctgtgcctcgcagcagggggggaagtgccacagctgtgccagagactggaaaactcaagatgcgcatgacatgttcattagttcccctgtatagccagggcctgaaccacgccagtctccagaaccatccacagggaagcagaaggagtgtttactatacccaaaagagttagacacgatttccaccaaaatgagttgcacaacttgtgatccctttgatgacccgagaaggttagtctttaaaacaagaacacatctctggacaggaatagacagaaaatattatgtctgccaatgattacagtttttttctgactttattagcagcctgctctgtgagcaataaaaaatgaaataatgaataatactttcagtatccaagcatctatgagagattgaaagaatttagatgtctcttctctttatcagaaagacagatttgtggaaaatgcctggctcacccgttgcaggcaaacataacactagttcttcctagtgtagtagccttctactgcattctacattacagtttcacaataataaaatagttatttgtctaaattaaagtaacattagactaacaaatttcaatttgatgtcctttgccgcatattgaacatacatattcacacatagctttatatctgcaaccctagatataaatatcccatattcagttctattgtgagatttttcaaaggttattcacatgctttctagtgccacattctttcaaattttaatcatgagctccctaaatagaagtcatttgcatctgtaaacattcccttgcagtagtatttagcagtgtattctctttgtgcagagctattttaaaaggaaaataaaccttaatatggaacaacaatcaagcatgagcataaagaggtaaattagaggcttgagaaaccctgtaaaccctttatgtaatttctgaaaaatgtctgaagtttctcaatcttaaaatagcccagaatcatatagcttatttcagatggtggattatagggatactattcatataatccaacttatgacctaaatcataagaacatattcaagaaatgaaatgagtttgagataatttactattctgaaatgaggccaaataagtacacatggttcaagctcgaaatgatagaccattatcacaagtgatggcgagttctcattagtctggcatttctaaatcaatgttgtagtcaataaatctgttgcagaatggttacacatgatcgtttttaggaattaataacaagacatatatttttgttttaggattcttttcactccaattactctagaatattatttcttcataatgtttatttttctctatttaacttgaccaaatacaaattagaaacattaaattatttcttaattgacatggagcttggtggaagcaaacatcatctcaggatgtacaatactattaatatttttataacagctatcaattatctactatttccatgcaccaggaactgtgccaggtttattaagtttaatcctcagcacatttcttcgaggcaggtattattatcctcattttagagatgaggaaactgaggcttagggaggataagcagttaggcgatgtcatacatagctagtgtagggtggaacggatattcaattccaagtcttcctgatgccagaactatacaacctcagtttacagtataaatcatacttttcttcctgactaccctacttcaaatatttgtttcataatttcccagaagctcttaaaggcccttccagaaaagtctgggggaggttgaaacttggtagaacttgactgtgtaatcttaagcatgtgcaacagatttcaataaaaaagctgcatggtgattttgcccgcagagacatgccctatgcatattttctaatcaggtgcatgtcaagaaaaagccttttaatattatattactgtaactgtcgtactccttttttaaaattttagtttttcaagctacagtaggactttatgatgtgctcctaagtacccacatgcactatggcaggaggaaacaggaaacaaacacagtaacctaatgttccaagaagaaaactggaagaaccggcagcgatactcgccatgaaagaagacatttcccagcctggccttgccatctctgacctcacagcatgtcccttgagatttgggcagcccttgcctgctcccactcctgtgatgcctcagccctggccggaaagagaagcaaactagctgatgatgctgtgccacgagaaccaaaaggaacatacaaatcagaaacgtctgttatccaaacccaactgagaaggctctgtctcaggaagggacctccccatttacatacagacattccagggcctttctggatgtctctgaaaagtaacagatgcagcagattcactcatttttaccttaaagtcaataaggtacaccaaaggtgactttgtatctatttttttccttctgtaatgcaagtatttaatcaatgaatgtcctatttaatggcatgtgttaacatttttctataccatctgtttgccaaaaattacttactttaacagaccgaattcacagaatctcagttagcccaagaagcaaaaaggattctgctatacttggggcaaatgggcaacagtccagagtgatcctggtggaaactaagtcagatcatgttacttctgtgttctaaactctccaatggctccaatctgactcagagtgaaatcccagatccttaccatggtctatgatgaaccgccccccatactccatagcaccaattaatatttgtatacatattctatgtatttatatacatagaatgtatacaaatacatatatttgtatacatattctatgtatttatatacatagaatgtatacaaatacatatatttgtatacatattctatgtatttatatacatagaatgtataaaaatacctatatttgtatacatattctatgtatttatatacatagaatgtataaaaatacctatatttgtatacatattctatgtatttatatacatagaatgtatacaaatacctatatttgtatacatattctatgtatttatatacatagaatgtatacaaatacatgtatttgtatacatattctatgtatttatatacatagaatgtatacaaatacatatatttgtatataatgtatacaaatattaaattaatagaatgtatacaaatattaattgtggtttttgccattacttttaaatggcaaaaaactgcaattacatttgcaccaacttaatacacattctgcacatgtctacgttcctttccctttgttcaacctatttgagccatgcaggccttcttggtgcttctccaggcccacgatctctgcagcctctggatgtttttctgttctctccacctggaaaactctcttgccaaatagacacatggattgcttcctcattttctttaggtccctcctccaatgttaactattagaaaggcctttcctgactatttcatacatacacacacacaggtatacacatacaataagtatgttttatatatatatatcacaatttccccagcttcacattctctattcttcttactttacttttccatcatagtacttaccacctacttgacatattttatatttatttatttgcttatttaatcccctcccagcctcctgtccccagtagagtgtagcttctattaaagcagggccattgcctatttttttctctgttgtattcacaaagtctaaaatacctgttgaatgaagtaagaaaggaaggaatcagtgaatgaaagacaacatcacctcaagaaaaacacttgttttctcactgatctgctctaactgcccgcagaatcacaagtttaaattagaaaaaagtgaaataaaaagtctaatcactggcatatgattaggcatatgagtttcgtgcaatttaagtaggttcttaaatcagctatcaagatgaataagtagcttatttttcaacatatactaggtttttcttcacatttgtgcaaagcaaaattagtttaaacgtacctttgaaaaaacttatactaataacttggtagttattttcaaagcattcctgcaaagggtgaaggcagatgatggcaaactatcaaccaaacattgagtctaatgcaggccctaggttattcttggtgaccttttttgcagtaatgccgagtaggagcagcagcagccctgattagcccgaaaacgtctaaggagtgacatagacctggaagacattctcattaccaccatcatcaatgaccactttcgcatcctcagaccaagcggaaagctaaaatctcggaatcacaaaactcaagtttatgggggatcatttaatttattctcttcgttttacaaatttagaaactaagcttcagcatttcagagagatcaagtggctcaccaaagttcatcttacttgggagaagaatattgaacaagatgacctgggccagggacacttatcaaaagaaaagagaagtgttcactcaaactacctaggacagaactagaataaagaaattgtccccaaagctcctcttaaatactaagaacccaatttttaggaattaaatgtttaatgaatttacattatagctagttctgctaaaatttatgaaacagtttagttgaactttttatttgctgaacatattctttagagtgcacgcaaaatcaatgtgtataatacatttatgtcccctttagagaaaagagtataattttaccattttaaataactatgaaaggttatggctactgcatctttgcctctgacatagggttggtcatagttatgatttattttttctcaaatatatggtcagagacacagtctcaattaagatattactcctgaaggaaaacgggaggcattttacaactctctgctttatgattctatttccagaaagcacaggggtgaaaagtgggagctgtctgtgatactaatttgaaaaactaatgaagtaatggaactgttatttctcctaatggctaccaggccctattctctgcacagtgtaatactgtatctacacatgtatgacttaaggccacagctactaccacaatgtgccctcagcaaaacaacgcacacacacacacacacacccatcaccatcaccatcaccatcactgctgccaccacatcttactaaggaaaaggcttataaaatttttatctcaattctcaggggccaagaattttatctcaatctcaaagaaatgttctttacactccctcacagctatcttttcaaaattttcaactacttttgctccttacaaccaatttgatcctgaaaagtatatgtaaactgaatttttagaacagaccactttttaaaatgctctagggctattgaaaagaactccatttttgtaaatggaataatcactctgcaatttatcttttgtaaaatcctaattttcttatgtcatgcttgtttaaaatgatatagacctgttcagaattcctcaaggggataaaaccaacattaattatttctttctactccatttcagttgaaaactttctctagaataaaaaacagaattttactaatacttggtagcgtctgccttgtcattctctttatattggcacagatcccttcattctagaaagcaagacttctcctggtaaggccttggtgagctctgacccttatgcaaatgttgagtgagacagccctggcctcccacacagacagaccaaaccatcttttatcgattcctccttcccttccttgtgcccctgtgtctacaataagaaagaagatatgcagtccctgctctcagggccttacactttaaagagtaaaatacaaaatttgaaaatgtcattgttctgaagaaagaagcaaaaggtttgaaggttctgtatgggatggagtggtaacaccaactattgaaccaaggggcccagtccaaggtgataaactccacatcaagcttgaacacaaagacattaaaatcttccaaggggtcaggttcaattagagcccttggcaatctggatacacttgctaatctgaagggagtaccagatgcaagacagttcaaaaagcattgactaaatacttacaccaccctaggaaatgaactcataaagacaggagtatgcctcatctttcgtctttggatcaccagcgctagaagcacctacatttccacatccagagtagcttcagaagacatcaaaatttggggaaccttttggattcagcagtcagaacccaaccattaaaagcaccaagggcatccccaaacattaagcctgtgagagattggaagggtgtatgggatgcagcaggaacaatgctctcgtgtaactatgtaggtaggataatgccttctgtcccaaagagataccagacgagaaactactgagtattgctagggattgcaaaactggctagtcattccttgcaaaaataggattctcaatgttcagaaccaacttggaaggcatatgtattagtgagtgcctgtccttctatagcccccagcttagtcataattgaggtattacttaatattttcatcaaagaatgtaagatggacttacgaataggtttataaggaaaattatttgggtgcagtaactagttattgaagccaactagttaaattgttcattaaagtggaacaaagttcaataaagacagttaaggcatgctatgagtcagaagcacagagcctatcacatgaacagaaaagccacttactaggtacaagtatgtctcaggaaaaatgaagcctacagcagactgcaaatcgaatgtgagttatgctggtctactcatcaaatctaatcagaagttttgttctcacattttggatctgcattcaaaatgggactccagaaagatgacaaaagttatataaaagacttaaaaccggtcttgtaggaacagccagaggaatttaagtgacatgattcttttttttttttttttttttttttgagacgaagtctcactctgttgcccaggctggagtgcagcggcgcgatctcggttcatgcaagctccgcttcccgggttcacaccattctcctgcctcagcctcccaagtagctgggactacaggcacccgccaccacacccggctaatttctttttgtatttttagtagagacggggtttcaccatgttagccaggatggtctcgatctcctgatcttgtgatctgcctgcctcagcctcccaataagtgacatgagtctttgaaggaagagaacactagtctgtatatgttgctcatctgaaaagaagactagaggcaaggatgtgtttttaactatacagaaagtctggttgcactgaccagatagaaaggactagatgatgaatggtattaaaatggatttttatgaccaggagaactatatacttagtatactttaaatgtgaatgggattttgtaaataatctaacctaatccatggaagtcagttccctcaaaatgctccataaaaaaagggttcccaggtctaataaatttggtgagcactgtatattgcaccactcgctttgaagaattaacaatacacagtatcatatttaaggcatcagaaagtttttcaggaaaaaaaataactttaacaaaattaacttaaatttaaacagaaattataacatcttaataattttcttgttccttgtaactgtctttggatcctcaatctagcctaactccctctcttacatttgagaaaacagactcacttatatgactggccctagatctgattagagttgggcagtggcagaaatgagacttaacccagtctattgcatgtcttatattctgttgatgccaatgaaataaagctggaaattaagaaacaggatgttttccattctttgtcgtggagtcgttgatttttcatattatatccattaaaagaaagaaaagtaattaaatttgagataaatcttaactgaaaaatataaaccacattctttaatttgttgaccacagctaaacctgcaaaagcactagaaaaatataagagtactagataaagataaaataatactgtacaacacactagaaatataagtggtaaattgacctctgcccctgttgcacttaaaggattaactgcataaatcttctctttgttttgaactattccacatattctacagtactgttcatcagtgaaatacaccctggttttggccagtggttgtttctgcctattttgcatcactacctaacttccttaggctaaaaaacaaaccaacaaaaaaaatactctgaagaactcctctttccttatctcatgcagtcttggagctgtcggtcaaagtattctctattctttccaaagcacaggcatataagccaatcaaattccttctcccaggaacttgcgtcctgagtagggtgacacaaggaattgaaaaatgttagagctaagaaaatcgaatggctgagtcttgatgaaactatctacttgtttctatatttaagatccccaccactgtcttggttcctgtccatcctgaggtcttcagttaaaataaccaaactctggaaggaaaagtctctctttttgtttgttggtatttgacacagggtctcacttggttgcccaggctggagtgcagtggtgcaatcatggctcacaccaactataggcatggccatcacgcctggctatttttaaacttttttcacagatggggtcttacattgttgcccaggctgggctcgagcgactctcctgccttggcttcctaaagcactggaattacaaggtgtgagccaacatacttggctctttttgtttaagttagctgaagttgataaatgttgtttataaatggagaaccttaatgaatataatactcatctgtggtgtactttgcaaatggatggggtattatcaaatgttcataattattacagggatcatacatttggcaatgaattattccagagtgtagacacagaaatgaaaagtaatattaatttaagtgtgatgggttaaaaaaaatagctcttaaagtcatctacaaataaggcttgccaaaattttaaaaatatagattgggtgatactaactttgggcgacttattgattaacctgtttctgatggtagaaagaattattctatcttgtgtctccgtggtgtaattttattagtgaagtgacaaaccatgcttcccagtggtgccttgaactgacttggaatgtacggtaaaatacagatttcctcaaatgaattgccaaaaccattaatctttatctaaggacccataatagtttgttctcagtagcaggtgggggagagagagaaaatgtcttccagaaagcactttggcagtcaatctggttgataataaaacttgatgaaacatctgtgattaatattaattctgattctctctttaatggataattgtgaaaaagataatttatcccatttcatttagactacagctgagtttttcaatttagaaaaagaacatttctccacgtttctcaggtatgagactatagggaaaaaaaaccaggtgcacaaaacctgccaacagacaggcaattttctagttagcccttgaaaatattttgtacacgttcaactgaccactacagatttggatgtcacccccaaatggttctctaagtgagtagactgattatttcttcatcctcaccactgtagaacactctaaatgaaccacagtgaactgaattaatactttttgaactcaattaatatatttggccatatttgattctgcaaagatggtaagaaaaatgcccttgtgagtaaatgacagtgagctatttctgaccaccagtgtatttcaaactagttgatgatagaaactatttttgacacatgcaaatgtataattaaaagtacccataaaaatttgtcatggaagctaccattaattttgacagaaactaggaaagtaactaattgcctttcaaatatcaatattaagaaaaccacttattaaactagcacttcaactcatttacacatggaaaacttgaagcatgggttgaagtctcctgcccaactctccaaacctaatgaatggtgaagccaaaacccaggcctcctcattctcatctcatctatctttcaaaacttaataatacttttaaaaggaacctatgaaataatagacttattttctaagaatcagggcatattatatggttaaaaaaatgactgttgtctaacccaatacagaagtggtaaatagtgattaagtacagatcactgttgacctttaatcataaccaaatcattgctccatttaaattgactccattttcatcagactctaactgacatcagggagagcaaaacaaactgacaagcacaaaaggcacagacaatgggcactgacttcttcagtgttccttccaaaaacctcatgtcatataaatagaatattacaggaactattcattattcatttctttctctccaggtacacattttccttcgaaactgttggtccaaaatgaatatttcttatcacttgatatcttgcctgttttctatttttatgtggctttctgattcttatcctaacacagcttgccactttgaaaaagaaatttattttatgataaaaaattttgttcaattgtacaagaaatgcaaaaaccctaaagggttctatggtttttgtttgcatcagcaaggtcaaattatgtctaatttacaggtaaagcaatgagacaatttacttggtcaggcagaaggaaggatttattatgaccattgtgaattagatgactcccagaatcttagtctattttagtctttatcttagacttagtctctccctaaccagagctccctggattataccaacattcacatcacaaagactgccatttctcaagactgatggtactgttgacatgacccttccatttaatcaaatcctctagtacccacttctttcaagtcttgaattcagacccatccattcctactttaagccaatgttctcgaagtgtggtacaacttgcaggaaaaacagctggagggcttattaaaaatagattcctacattgcaacctcataaagttgaacgaatcaaactttatggaagtgggttccaagaatttgactttttacctatcatctccagacagatcacgaaatttgggatagcgtcttaagccctgagacttaaattccaccttgtccctcaaatcaatatgttactacatctttaactgatctcttcctcctgaaatagtcgtctctctctcttttatggaaagtgctaatcttataattcactttatttctctttttgctgttattttcatgaatatatttttcccacactggattgtgagctcctagaggacaaaaatcatattgaatactttctccacactgtcccctacattggccctctaggtaaacatagctcagtaagcactgatgaactgcttgactaatgagaaaataatatgtaatactgaagtgtgtccttctatagccactgtagattttctacaaatataatgatgcacaagtaccaacagcctcaagtagagtttaataaaggggttttatagcatttggaatacaaatatttcacaaaattgccacaataaatctaaaatatactttaataataaactaacacattgtagctaaaggtcagaaattctgttatttgattaaactaataatctagcaaatgttattgatttagcaattccacttaatataaatatcataaaaactcatgcaaaaatctctatacctattgcaaaggaactaaaggcaattaaaaaaaaagagaaactcaagtaaaggatattaatatctctgagattagaatcatttctgcataagtaccagtactatttatagaataagcttttgaacactgcttttcacacatggataagagctaagggcatgaactttgaagtcagaatgcctttgctcaaatctggactcaactgtacatgaacagtgtgattctaaacaaatgatttgacctgtttgcatttcagtttttctcatttgtaaaatcggaacaataacagtgcctaacacgtacctgtgataaagtatggatgagattatatatatatatatacatatggaatggataagtgcttactacatgctagctattaatatatacccagcaagcacctagtcataaaacaaatgatttcaatgtatttatatgataagcctcaaatcagtttactctttaagaatatactactactccctattgcctgttacatatattcaaaactcttcagaacagaattaatggtgcttcataatctgacccaatctatccagtttttattttccaaatactctccactccattcagaccttttcattgatccctgagtttatgctgttctgattccttatcaggagaggcgaggccagtaagagaagaaatccacgtgagcggtgtgaagcttgttttttggagggctgctgggtgggctccctgactccggtaatcaccctcatgaaccagtgccaagatcccctctgtgtaaaatctgggtgctgcacatggctgctacaattccttaacttcattcaaaaggatttcaaatgttataaattctcagtgtctttccccttatgggagccctactcatctttcttgtgcaaagatgtatagtaactgcaagtctgtaaaacactggtggattttaaataacaatagcaacagcaagtataactaattacaataagtgaaacaataatttgcagctgctgtgctgcttaaggctagataaggtaaggcaatccctggcatggagcatcatgttaacaagctgcaatgttgagacagttgttcactaggctttgcaatatatccaccaacgcctacactgtgctattgattctgttaatgaaatttaacctctgaaaaatgactcagggcactgaagagacatatactttcaatactcttgctaatcattaaatgccttcatcacaattgaaacaggaatggtgaatgacacatttcattatgtcatcatgtctgaccccacaaaccattcaatagtactctgctttgttctataaacccatttacttcctagtatgtaaatttcaggaataagttgacatgaaatttccctatacatttcccattagctgtcttgagaacagggtctacctaagttccaaggtgaaggtagaacttagataacgacttgccaatgatgcttgaaatctgtctacttttaacgtcttttaaaatatttattatgaaataattgaataaagactctaggcttggggtcaaactacatgggttcaaatcctgaccccagtactaactacatgatctcaggcaagtcacttaacctctctgagcctcagtttcctcatctatatgatagataatgatagtaccggcctcacagatgaggattcaacaatttaaaacagatacagtgctaggtacagtgcctgccacttagtacatgcaatatatgctaaatcactctaattacaaccatcagaacaagtgttaccggaggagttattagttaaagcatgagtaaacctttagcaaaaggctaaactaaacttcatttaaatcattgcagtattcatcatactgcttcaaaactgactgaactgaactgcccccactgtatatagtaagacctctaagcaatatactaaaagtaaaaaatttgcctgttcacatttttagcctccaatttactctccttgcttacttagatttgcccattaaaaattccacctaaaatgaagcaagtatgtctgaaatcaaggttgaggaccaacagaaactgttaaagcaaaacatgcagtaaaacttaatcaattcagattttagtcagaatttgtaacaatttactggaggagaaaatgaacttttaaaaatgtctgtgaaaaaaaaaatcagacaaagcaaatttacattagaagcctgatattggaggtactaaaaattgggcaagttaaaaacaatatacattcttcttaaaaatgattcagagcacatgttatttgtttttatgggtttacatgcaaaagggaatgttaaccaaaaactaaaacttagctaacattaatgtagataaagctagttggaaatattgtatatctctaaaaatagtaaaatgaaaagatattatcattccaattcccaacaataatagacctggctggctgttctccaattcatgatattttacttttgaggctcagaatgaattaatttttttgtgaagctttaaactttaaaaccaaacccatacatagcatacatattaaagttctgttcctaatgtggattttatacaatctgacttaaaatattcgatggaaaagaagcctgttgccaaagtccacatatttcccctattaaacagaggtaagccatatccccagaaaccatatttcaagcccaaaggatactcatgaactaaaataatgaatgataatgcctcgttctctgcattaataataaagaaagagaaaacagaaaacttgatagccactatcagctttctggaccataaatctcaagttttgagaattgcttcccaaaagggtagggagcaaggatgagttgtgagagcttcggagcctagagatatttttttagcaagccagcaaagcactgacacaaatttctacatatctctggctgtgaaaagtctcatttgtggtgatttatatttccccataaagaactctgtagataatataagcctgctgtaaggctgtatgacaactttcaaaccaagagttacatgaccatttggtgaaaatagagcaagaatagatgagtgggaaagtctgtagaaatagtatttcttctgatgaaaggcccaaatgctgttcttccagcatgcacgaggttcagagagtaacctttcactctgtgtgtatgtatcttgtggataatattttggtcgtctattctagaaagtattatttttttcccaaagattgactatgcatttggtgtgtgcatgcttgtgtaatttacaagaaatgacactcagacatcatcacactgaaattcagttgccttaataagttactaagagaaacacagagaatagcatgctgacaacccaaagtcaatgaagtataaacactgttattccaagtgtcactggtgtgttatttccttttttcctggcatctgctctatgtaacactgtacacacacgtgatacagcagctcattaaactgtttcagttaactctgaaaccaaattagtgcattacatgtttataaggctgagaattactgcttccctgtgaaattacacaattaatcagttgcattatttctttaggagatgcaaccacgtttgacatttaaggataaaaagaacaatcctttaatttgtttccatttcaccattgagtctcagtagggtaaaggaagcaaaaggtgacataattcctccttttcccttaggaggtcagaactctacatgcttcctctgtctcataatagcattctgaattcttaaaagcagtacaaataaaaattattttggttttgaacttctcgtctgagtgtcacagcctttgaaaaattcagacaatgggaagggtacttaggagtcttcagtttcttatggctttataccgtgaatttccatcaagtcctgattattgagtaacttttaaggctccttttgcaaactttcaagatggtcccaatgtaaaaatctattaagcggtgatatctgctctattttcctttttcacagacctggcattaatttctctgattcttttaaacaggagttaaactagactcatcctttagtcacttaacagggcatgcatttccttttaaaatccatgctacttgatcaaataacttgtcaacaaatttaaaaatacttttcaataccctgtgttcctatgaattgcctcctccacctttgatttcactcaaactatgtgaagtgtgctaggcgaagccattaccagaaggcagaggtacaggtctagctccaacagcacctgagctgatgctgcgtatgcatgctcagaaggttaagagggcacctggcagtaaataactgttttcataagaggaaattacaattaacagaataatttccacaagtccctaaatatcctctttcatgttctttatttaaccttcatttaagagcccttgaaattcattcatgctttcctaaaaaatgactagggacaacttgaaacagacacaattccctaaactcattctttaaataaaaaggtgcattattgcagcttcactaaagacctgtgggagtatacaaagcgaatagaaggactattttcaaatagagacccgatataattcttaaaaaatatgctggctttcaaggggagaaaattgttccattctattttcaaaataacacaaaacttacaaagaaaaactaaatagtttttggtgactaagatgtactttgcatctatatctgggtacttactatctgatttttgtgccatatgtattctcttccctttagaaaacgttaaaatttgtcggtttcccaacactgcccttccactcttctgtattaatacaagtgtgtcttaaaacaccatgtgctagtacacatacttgaaaaactagaggaggtgcaccagtatttgaccacagtcctacagaacatttcagttataaacctcttcaatcttagagaagttgatgctacagtaaataatgctaaaataagacttcagtaatcaaaaacatttttcaataacaaaagtaaaatgcacacacacacactgaagcaaatatcgagtgtttcattgtcagaaagtacattgtacttacaagtcatttcccctgcaagagtaaaagacaatgaacagtgaaaaagactacctcctgctttgataattgtgccattttgacactcttctatttcaataagaaaaactatgtaaaaaaggtgattggtgtgaactgtccagagcaaaacaattcttaatgtagatgactaaagtaaggcactgaaaaatcagacatcaagaggaatgaagaattccttatgcatagtaatcctagcataatgctccttaagaatataggaaatggtcttaaaacttaatctttatgcatttatgaaattttttactgaactaaaatatcaatctgggatattcaagttgccttaacttttcaaaaaatgcaaaactttttggacttggattactgaagttgttattttggcaatcaactggttccttaaacaatatttcatcgagactcaaaaatcagaaaagagttgtgattattacacccattttacagatgaaggaattgaagctcagtgaagttaagcacattgcccaagttcccacagctagtaagagcacagaaagaggattcagacccaaagctacacttaaccagagtctgtgcttttaaaaaaaaaaaaaaaaaagaaaaaaaaaaaagaaaaaaaacacacgcaaacaacaacaaccatgttccactctctgctttgatgttatgtattcctagcatattatttttttaaagtactaaaatacgagggaactgctggagagggtgcagtaaaacttgagccctgtaatttatctgcttttctaaaaaacaaaattagaaatttaaaaaattaattggttttttgccatatgtggtttattatggcatttatccatgcaataaatatttcctgagtaactcttctagatgctgctttctgcaatttttctttgaaatatatagcttttcatcaatattatggctaagcagattatccatattatggaaaacttgcacttctacgaaaaactatattctgaattctaaacaactcacctgcaaataaggttttgaaacacatcgatagttaaatgaggactttcttcaaattagttctgttttactagttttactgaatattcttatacttttaaaaggttagccaataactgtattgtacaatcaaatgatttctgaagctgatcttgatcattttaataagatagcccttaggaacttaggttactttgttttaaaaattgtacagtgaatattaaaattgcctcatggcttaagataaaactgtaaacttttaatctaaatacctaaagctgagaattagcagttaaccacatacatttaagcatctacagactatagatttaaaaatgatgtccatagtaacacagaatgtcctagtaataactcagatataacaaatgctggaaaaattctcttttagtatcattttcagaaaatgacaattgtcttctttattatagatctctcattaaaacatactaattcctgaatcaagtgtgcaatcgtaattcagtctggatggtgaatattcaggacatttaaggagaatttcttagaaaatgcaacttttctggtttctgaagttatctgagttaaaaaggtcaacgctttgggaagatacagttgaaatatcttctggagatggaaaagtatcctttggagaggaaaaaatgcagaaatatgtttaaaatttatctttctaccatctgattcggggttcctaggaagtgtttataaagtagaattctctaaacagtagatgatgtcagagtgagtgctatttgtttctaatctgtttttaaaaaatataaagtgtattttttcaagtataatagaccccaggactttatctcctcatttctttctttctttttttttttttagacagagtttcgctcttgttgcccaggctggagtgcaatggagcgatcccagctcactgcaacctccgcctcccaggttcaagcaattctcctgcctcagcttcctgagtagctggggttacaggcatgagctaccacgcccgtctaattttgcatttttagtagagatggggtttctccatgttggtcaggctggtcttgaactcacagcctcaggtgatccacttgccttggcctcccaaagtgctgggattacaggcatgagccactgcgcccggccctcttcttttagttgcttactcacttaacttcctcccagatcagctagttctcatctgtgtgaacctttttcaagttacctaacttttctgggcctcagtttcttcacctgtaaatagggaaaaagaatagttcttcgtagtgctgttttcagatggcgcctggaacacagtacatgctatataaattctagttatccttacttattaaacatctgcatgtgccaagcaatgtaatacagggcagaaagcaggaacagctgtgaacaacctaccataaatatataatgtcagggatgataagtgcctgaggaaaaataaagcacagtaaaagtatagagaatgcagagaacaaggtgttatttttatatagagaggtcagagtcgctgcctcttggataaagacattgtttgaacacagacctaaagaaagtgagagcaaggcacgtgaatgcctggggcaatgggaagcccaggtagagggacaataaagtccccaggtcccgatgtaggagtgtactggataggagagggaggagggctggcagctgagtagccagaatcaggcagacggtggtagcagaagtcagaggccgagggaatcagggaaaggagttcaaccatggaggaccttgctggccaggttagagactgtggacttttgtctgggtgagacaggaagtcactggagggctgtgacagagctctgaggctgtgaggcactgctctgtcagtgccatgagtggggaaaacaggagcttgctgcactggtagagaccacagataatgatgacttggacagagcagctgggagagaactagttcaataaccctaacacgcctctccattctgcattttccctaaaaatgtacctttaactaggatttattgaacatctactaagcaaggtattgacctggaccactgtacggatgttatcttttaccctaatgctgcagaccctcagataaaatataataaaattaggatattaaagctccaagaatttctgaagtcaattataattacattattttacagatgtagagttcaaactccagatggatgaaatgattctctcaagatcatacagctagttaggtcaagaaaaggacctgggactcagttttccttactttataaaagcatatattcaaatcagtgttttatggaattacaaagataacttattaaaaggatttccctttaccccttctgatgtaaaaataactgcaaaacttctatcaaacatattctcattaggttaatatttaagagtatcatttctaaattgagtattttttaagtttctaaaaggagtattaaaaaaaaaaaaaagacagggttttgctatgttgcccaggctggtcttgatttttttggctcaaacaatcctcctacctcagcctcccaaacagctgggactacaggcatgtgctaccatatccagctaaaatgagtatttttgaattttttaaaattactgtttcctttaggaagtctatataaacaactattgtcttaatcaattgactggcagttctgcaaatctatcattgatataaataccgccaactttctgtaattactttagtatgccaatctcttaccaaaataactcctgtagattaaaaacagtatttgtcagattcagagatggccccagtctacctcagcaataatcagcaattataacaacttaatatactgtctgttcccaaggaaaggagaatatagcatagttattcttgggagttaaaataaagggactagaactgcaaagcatgttttatttttaaagtaaattggaaacttcatttaggatattttcaactaccacattttcttaattttataaaactcaaagacattaagaaaaaaagaaatctggttgaggataaggcaaatgttgataagaatcttctgactcatgtcctctctaagtaatgaggtgaatagcttgttatgaaatccttgtcttcccttcctccaaatctgtgtttgtatctgaattttggcactccacagtcttcactatacttaagcctactcctagcaccataaagcaggatggccaaaaagctatagctttcttttttctttctttcattttttttttttttttttttttttttgagacggagtctcactctgtcacccaggctggagtgcagtggctcaatctcggctcactgcaacctctgccaccctggttcaagtgattctcctgcctcagcctcccaagtagctgagattacaggctcctgccaccatgcccagctaatttttgtattttttttttttttttagtagcgatggggtttcactctcttggccaggctggtcttgaattcctgacctcatgatccacccgcctcggcctcccaaagtgctaggattacagatgtgagccactgtgcacagccagctttcttttttctagggaaagtaagaagagattttaaggctatgaggagctaagaggtactgctgtcctagcaagaacattctgtaaaattgactggtgggcagtgaagcttgttcctgagatcagcaatagagcatcttgtaacgtagtaagtgtgaaaatagctatttcccaatcatcttgttcattccacacacattagggaagaggaaaattcaactgagggccaattctcccctaagaatcctttagtttaattatgaccacagtacattaaacgtctgtaagacaaccatgttagctctgctgctcctgactgcagtggtggaagagaagaaaccctttcattactaaaaagacagggaaggatgcctttgcgggtcgaaaacatggttgaaaattcaatttaactgaacaccaagccactgtgcttcttgttaatgaacatctttttgctgctaattttgtgctattttacctttcattaaaaaaagtaattcaagttaaactcagctgaacagcaaaaagctcttcatattttgaagcattttggaacaattactttgacggaagcccttgacagttaaatgactccgttaaatgaatgttatagaagtcacataatgatttttagtgaaatattgaatttaaccacaaatgaggaaaaaccagtcataagcgctatgggtatatttgaataataacatcttgcttatgaagctgaatgaattctataatttctaataatcaggcaatcaactagttagttagtgggtatgttcctcatcttggtgctctctattcatttttgatttttgcttttgctgttgtttttttaatctgagaagccagtaagaaaatttcaaaactagcaagaattttctcttacattggtatagtattttacagtgagacaactaatgagttgctgtcccacaaatgaagtcctcctctttcctttttctcatatgctgaatgagattctttcacaaagtaaaaaagcaataaaagtcaagaacatgctgcctgagaagtgtgaattcactgtatgccagtgcttcctgcatctgtgggactcaatattccttttcttgttttatggatcaaatgtgagatagtatcaaggcttttgcatgttttctcatgactaatgactgaaatatgtactgaaataataaaactggtactgttcaatttcctttttaaattcaattccaatataagtgacagttatcattgtgatggtgaaatctgacttattataaaattctgttttctggagaaggagaggagctagaaatccctgtagacttaaaccgtgtaagttgtgagtgggtagggacatttggactgaagaaatgagtcagaaaaaagaatgttcttgtttgtctggcaagctggggtgaaagtcgatgctaagcatactgagtggtataacttggatctctacccactgtgtgtggttgcatttcctgattcttccaagcaggtgaggcacaactttctccatgttctcactactccctgaatttatcttcatcatcagcaattgtcgacttatactttaattgcctatttacatgtctgctccccagtgaaaggtcactccctaagaacagggaatatcttttcatcttgcatcccccagcatttctcagctcagattaagctgtccaataaatgtattttttaacaagtaaacttttaacctcttcagttgacagtgagaatacatgggaaaggccagatagtttaaatataaatactagttaaagtccagatacacaacaagctgcttaaagtagctaccacctataatcttgctactcaaagtgtggtccacagttcagtagcagcagcagcatctgggagcttcatacatccagaatttcaggccctgccttaagacctcctgagtcagaatgcattacaagatccccagataacactatgcacggtgaagtttgagaagcatttacctataacatatgatagtaggaggtatgaagaagtgatgggtatataatggagaagaaacaaggccaggcattctgattaatacagaagtctactgagaaagttttagagctctcccaggacagagtcactcaatgctcacaggtcggaaactcgctcataccagttaccttggaaccccttctagacacttcttcacaagtctttcctgtttaaagacagagctactcttaataattatcttttctccttgctgcaaagagagtatttatcgtcaacatgctgacatgtccaggagttttggcttcctccactgaaaatgtggaagattgaaaggatattgctgacacctgaataagaaatccaatgactccaagctatgtaaatttaattatttcctttaatttttttttcaggagtctttttttcttttcctgagctttggagaagtcctggcaattttcatttaaaaaaaatacaagtcagcagtggttcagtgaacaggctgacacgtaatttcatagggggagacgcgctctgtctttaatctaatttgtgctctcaattcccagctaatgtatctagggatcctgatgtacgcatttacaaggagatatctgtaatgcagagtccagctctctgcaattctctgaaacatgggtaaaaaattagtctgggttcttgcagctgccctacaacacgataaatctctatatactcacagatgtagaaatattctcggcctggcctgaattcaaatcctagagaaaagggagtgaagagctggaatttttcagagaacttcagcggtccatttggagagtgaggccggttacattcccatctcttgaaccctttggaagtgtggtcgcaggcactgtagccatcaaagttcaccatgtagaggacatagcgctcagtcttatcttctgggacggagtcctcatagtgagggcagaaaacatccaggtagtcattgatacagacatcaatatggtagtcacccctctggaatctgttagaaaaagaaaaaaaaatgtgataattcatagagaaagggctttctgcttggaatcagtggttaagccattcaataattttggagctaaagcatctagtatagtaagttcttactgaatgccattatgatttggggcatggtttgaaatgttgcagttcccaatctaagccacaaaaagccattttacagtgagattccattatatttgtttcaaaatatcctacaaactaagtgctttgctttcattttaaatattatattaaatatcactctttcaaactgtggaactctatagaggtactagtgtgctgttttccatgtttcctttcattcttaaaaatcatatattaaaacaaagtttttatatttttataatagtgtttcacttgataaatatttttgaataaatgaatgaggaaattaaagaacaaataaatgaccgaattgttttttgttatagttgaggccattttccactttctatgcaaatgagaattacagccataaaattgggagaattagaatcataacattttacagttagaaagacaattcctaaaacacttccattttagagaaaaataaaaagacataaagatgaagcagtgagtgattgagccaaacctagtatggagacttcggatcccagttcagtgcttttcttagatctgctacgtcagaaacttattttagtgcatctcgattttgatgcagcatcttttccatactgagaaaacaacccatctaaatcaaatggctcttcccctcatttcttttaatccctcaacaggtcatgttctagagctgggctggtgagtaatgaaagtaacaagccaaatgaaaatagccaaaaccacggctaattcatcctagttaaaaatgtacacacctgaatacacacacctcccaccacaaacaccacactgtctgcttcaattctcatctcacaaaagttttgcttatctgttttaactaatgtgtctttccccatcagtcgaacagtatttcccaagacacaacgatgtgtgaaacaggaactgttatgcatacaactttctcagtctaaaatcatggtggaaaagcgtacaaaactcctttgtttttagctggtgaggaaattcttctctgagccctcagaaatttcatcataaaattgtgttactgctgaaatacaatgctcataaagtcatataatctccaagctggacagtctgagtgtgaacacttcccagtggcagtgagatagtttattccatttttggacatctctagatgttggaaagtttcttcttatattcagcatatccgcttctgtgtaatttctacccagtgatcctacttctgctgcctggaattacaaaaaacaaatcaaattcctcttctgcaagggagtccataaaacatttcaagatgtcagctatatctctctatatcttcctttctgcagacatttgaaaatcttgattcccttggttctttctagtatagttcccaggctcctcatcattctagattcttgacccttctcatagtctccagtttcccagtatattccccataaaatgcagcacccgaacataaacataataacgacctctgacagtttgtgaccaatgtccaccccagtagaaatataccaccttctagccgggtacagtggctcacgcctgtaatcccagcactttgggaggctggggcaggcggatcacttgagtccaggagtttgagaccaatctggccaacatggcgaaaccttgtctctactaaaaatacaaaaaatattacccaggcatggtggcatatgcctgtaatcccagctactcggaaggctgaggcacaagaatggcacgaacctggaaggcggaggttgcagtgagctgagatcacgccactgcactccagcctgggtgacagagtgagactcggtctcacaaaagaaaaaagaaagaaatagaccaccttcactctggatgctaaatattcattgacaagccaagatactcttccgagagacaacattgtgaaaaagtagagacaccattcattttgactaagtagacctagatttaagaactggatctgctgttggttgagtgggagagtcataaatcattctgagcctcagtttcctcatatgtaagttgggctaatcatgagaacctgccttgctggcctctggtggctgcttcaagccttagataaggaaatgtatggaacaaactgtgtagatgtaaaccactgttaccatcatcaggatataccaaagcatattaaaataagtaaataaaatattaattttaaaataatagcagtaagaacatacaacagagataaaaataatatgtatatttccccttttaaaaatccaaaaggaaaatcatatagaaatgttaaattctgtccttaaatgtcaaatgatccatagcaactccacttgacccttgctcttgaaaagcagcatgctgatttacacaagagaaataaggacaaattctcagaatattcacttttcagctagaggatcccaaactacataaccatttttttaaaaaccgaaaacacttggaagtatttatatatttgcaatgaccacgagtttactttttcttcattactagcagacaatgatttgtcaagatgcaaggaaagcctgtgttgcttttaaaagatttttgaacatcaagctaacatcactgccaaagtacagagaaaagacactgcaaagttcagataaaagggtgctgggatatgaagcatcagcactcagagtagcctgacagttttggataagagccagacaagaacagcagaaggcaatgcccagatgcactttatattattatattattattatagattttaaagagattcaagggggaagttttttctttccctaagtgtcactcattttagcttccactagcatttggcactgctcaaagtgaaagtaaaaattaaaactgccattgtctggacccattctgttactcctttattctgtaattcctttattccacaactgaaaaaaaaatgtcagtttcttcatgcctagaagtttgctctcctttcctaactcttacccctgttaatgttgctaaatttttactaaagcaaactgtgaggctgaagacccattctactttgtgttgaccagctatcccttctgatgacattttattttgcatggagtgttaagtgaattacggtggtacctatttcaaacatgcgattgccccagcaattattatttctttctttctttttttttttttttttttttgagatggagtttcactctgttaccaggctggagtgcagtggtgtgatctcggctcactgcaacctccgcctccttaattcaagcaattcccctgcctcagcctcccaagtagcagggatacaggcatgcgccaccacacccagttgatttttgtatttttagtagagacagggtttcaccatgttggccagaatggtctcaatctcctgacctcgtgatctgcccagctcggcctcccgaagtgctgggattacaggcgtgagccaccgcgcccggccacaattagtatttctacccttttagcagccatacgacgaagaaaagatgatgattcactacagaatcaatttacacttttgtttcagatcttaaattcatatagtttagtaatgtacatttcaaagggtggacaatataaatataaaaacaatgacaaactggaattcataaaaggcagctatataacgtactcaagtataatccaaagaaaagtttaggatcacatatgctaatcctattaggttggtgcaaaagtaattgcggtttttgccttaatatatcaaatcatgttctctgggtataaagtagaatggaaccattcttttctggccatactgtgaaggagcacataagtatggctaatattagagtgcttattatgttacattcattatctcaacttaatctctattacgatgccacggaatagccactattattactacacccatttaaagatgaggaaattgagattaagaagtcaagcaacgtgcccaatattacacaactagtaaagaaaagggggaggcagaattcaaacccactctgacctcagaaccaaagctcttcacttttccattttgtgagagattaaattgctagagccaagtccttaggtcagcactatattcctccagagggacccattttcattcttgatgaggtttcagttctctccttcattcacggatgcaacaaatatttgctgcatccaggatctgctatgggctttacatatgttatcatatgaaatcctcgaaacaaccctattttgtagttttaattagtttcactttaccaatgagtcgaggacattcagagagggcattgtccaactttttatagctaataaatagcagagttaggatctgaactcaagtcttacatggttctgaagcatattcttgtcctcctaaccacaatggttccaaagcttcaccagctgtagtaacgaccctcttaagagttgggttacctttatatttacactggtcttctagcagagcattgcaacaaggtgtcccagccctactgtctcctccatgaggtttgtcccaaactcctaaactggaaagctgaggggtgtgtcaacatttagaataagcctcagattgcagggttagctcctgactcatcctttcacagaataacatgttgttaggctcagcagccattcacataaaggaatcttttttccatcaggaagcagctttcatgagctctagctcatattaaaagaggaaactgacatctaggaagactgattctgcatgccaatatttacaaatgccatgggtaacacagccattgctttaacatatttgtaaatttcttggaaaatttcttgtaaatgtcttctctttatgtcttatccttaattccatccattgtatcagcagttctatacctctatctgagatcaccacataattttaactataagaatttctggctgtacaccaagccagcaataattacaatacaatctctactaaattatcacagtgcttcacaatctaaaagcatgctcagttaccatacttagaaaagcaattgtgtttgagtcaaacaattacggccctgcctgttttcacagtgtaaaagtctcaagagtcaagaaacatctcatatgcataaaaagatggtcactgctccccagaaggctgcatggccacttaggtcaatgttctgtgcaacataaatagttgacccttgagcaacacgggtttgaactgcatggatccacttacacgtggacttgcttctacctgtgccacccctgagacagcaagaccaatccctcctcatcctcagtctactcaatgtgaagacaaggatgaagacctttaggattatcaacttccacttaaaaagagtaaatatattttctcttccttatgattttattaataacattttcttttcttgagcttacttgattataagaatatagtatatatgtttaacatagaaaatatgcattgactgtttatgttaatggcaaggcttccaagcaattgtaggctattagtagctaaggttttcaggagtcaaaagttatacctggattttcaactacatgcagggccagtgaccttaacctcccacattgttcaaggataaacttcatattatatgtactctattatggcaagaatacattgtacacatttatgaaaatttggtggtagactggttcagaatcaatgtcatatatattataaaagggtaattttagttaatttaggaaaataaaattcagcatggcaactagtcctttgcaatcatctcaaataccaaaaatgaattatgtactttatggtagttcttgataaaccagaggccacctggagcattggataaaaagcacgtatctagggctattgacagcaaaagtaacaactgaagctgggattagagctgaaaaagtgtgcttctggaaagtgtgtttgtttctcagtgtttacctgatgacattccattatatgctgaataaattttaattttcaatttaaagccactgttaatatctctcccttgctgagcatggtggctgatgcctgtaatcctaggactttgggaagctgaagtgggaggatcacttgagcccaggagtttgagccagcctgggcaatatagtgagactccatctctataaaacatttttttaaaaaaattagccaggcatagtagtgtgtgcctgtagtcccagctactcagaaggctgaggcaggaggatcacttgagcctcagaggcagaggttgtagtgaaccgagattgtgccactgcactccagcctgggcaacagagcaagaccctgtctcaaaaaaaaaaaaaaaaattgctccctgtactgaacctatctgcaagaagtaagtcatgacttgagtctcagaattcagatgaaataaagacaagagaagtgaggtaacagttgacaactaacttttcatttagatctcaccagtgtgccctcaactttctactgaggaagcaaagcattgtttgatgacattaggtagcctaagctgtaagagctttgtcctcctaagtatttcattttcaaacttgggtggctgaaaaaggtacatctactacttgaatagtctaggtcctttactagtctcaagtgtaagttctcaacgtactctgaccctgtctcttggttcctctttactaaggtaagtagataccacctcgcttttcttccttatgattttcatggtgccgacctgacttcctcctggaccccacactcctgtgttgtggatattgacagctggggaggccacattgaaaggacactcaggcagtgccctgggcttcaggctgcagaggagcagcaccataatcctccttctctgagttcatctttagccactttgccctgcagtcttcctcctttcattccatcctcatttgctaaagccaaaatgcatttcattttagtagctggaaaaggaagggtatggtgcatatttaaaatgttctaaattggcctttagcatatgttgctggcacagcagagaacctgcttccagggaaatatgtatggaggtattttatcaagaagctcctgagtgaagtttcttcactccataaatatagaaacagcattactgaaaggagacagtgttattagaggttaggaagctgtgagatactttcatcccccttcacattatgttttaaagaattcaataatgaaaatgttatttctcatgaactggatagttgattattacattttaaatatattttaatctgtcaaagaggtgattgttttaatattcctacttgaacagaaatccaatgtcacttctttaattacaaggcaacctaatgtattacattctgaaattgaaatgtaaaagaaggatatgatttatggtcaaagattaagcaaatttatcagcttagggttcctccaaaattttaaactaattctagagtgaatatatcttgggagcactgtcttcaaattctactattactgatttaaaggctaatttcagaacaagatgtctgtttttaactagtataatttttcatttgtcccaaaaggggctaatgggtcctgcaacagatatgggtttggtttataaatatgtttttgtgaggagatgggcaggacagcagtctctgttgtataacatgctgcttcttgcatccttctgttattcctttcagcacagaatgcaagccttatggctttcctattctaaatctgaagatgctcttttttttttttttttttttttgcttttctgtggaggttaaagcatcgaatacaaacagcacatcaaacagggtagataaataatactagcatcactaagggctgaacaaatatttgttttgttaattttaaatttctcttctctctcatggactgaaacatgtctatctttcagatgtattggtaatcaacctcaatgttcagctctgagagaagaggactcatggatagtttcactgttaccccaccaggtgtgaaggctgaatgagaccttatatgatgaccaaaacacataatttcagaccaatccagctcttccaggctttagaacatgctaaaatcaatgaatattcctagagaagtgaaggttcacaagttaaaaaagtattcaaggataaatttcaaagatttttcctacttatttggcagcagaaatgcagtatgctacaatatatactgacaaaatgtttggaacctggagttggtgctgtgtttatacattaatgaaagttccaacagagttcttgcacgtgcatgttttgataattaaaaattctgcagcataagagttttaccttaagttcagtaactgttgatgatgataagaagacatcattttcttggccaaatatttagaattcatcagcagtttattatactaccctgtcactttttttcttgtatgtatgtgtgtgcactttaaaagcaaaacatttaaaaatcccacaatactaattactcatatcagatagatagataaaattcacatagcttttgcctgttgcttttctactacaagtcatgtcagtctgaatgactttttaaaactgctatctcccagaaattgcacctgtttcatataaaaggcccaggcccacataatgttctctcctccagtgttgtaactcatttggagtttgttttattagcttgatggaggagtttcaaaggaaagaaagcattaaattggcagagcctaaacaagactttccctcaggaaggggctggaagctttgggtgacagtctaattgcttctaagcccccaaagaggcctcgggcatggagtaagagtgtgtcaacgtcaacagggccaagtcagccaaagaattaagcaggcagagttctaaagacctaacacatcacagatcacttcaaatggctttcaaaaggagattttaaagaaatagttaatgtctggcaatcagtatagtcctaacagacgtcactcccacaatgcaaaacacgcttttcctctactcctgctggccaggagcttcctatcaaagctgtacttcaggtcttaagccagtagagttttacaccccccagccccaacttcaagcacatgaagcagagcacctgccacatacacacagacccagcaaaaggagacacaggcaaccatcagataggctatctagccactgtccaaggagaacaggattaaacaaactgactctgatcaggggatgtgggcgtcaatcaaacaaataagccacctgtcaaactgcttacttccatgtagcccttttgtatcttctagatacaaaagagaggagagttacccagcagaatttcaggctattcacagtttcaaaaataataataataactaaagggttaataagtaaatctcctttttattgaccaactcaaggagagatttttggaaaagagtgatttaatagttcttaagtacttggtgtgcaaagagtgaactaaatgtttgtattatgggttgatgataacttactggaatcattacaatctaaatctgaaatttagcccacacttttaaaaaattgagatatctgataattaatctgttaatttattaaacaaacaagaaataaattggaagaaagaaaatacatgggttttatggctttcttttatgttttatcttcatcagacaaggggaagcatatatttggtaatgctagggcatgataataataataatgttttcatacaaaactgtagacaataaagcagaaattgtggctgtttctatggaaattggcacgtgcaaggtaattacttctatttggccagttaggaccttgtgagcagttggatacaaatctgggactgggaatgaggctaatacaaagaaaagagctctgcagtcattagaaacgaggtggtgatcgtagtcataaaaagtactgaattcatccaaagtcaatgtatagatttagaagaaaactgggactttgctgaatgcaaattgctgtaattattactatactagttttatatagatttattttttacgtatagatctccttgaaaatagtaatggtgtttacttgtctctgtatccccaacacttagcaccatgtttgcacatagtagcgactacatagatgttcgatgaagaggaatgtagctgaagggtatgagaagtgatgcttaaaaacagaagaactgtgtaaagcatccaataatctcttcctgtgttctgggtcccagtataaaattttgagagaagctaaatattataaacaaaggtcaagatcaggaaacaaaataatggcaggctgcaaaaaaggaaaatgataaccaggactgttgttcaagcaatgctagaaaattatgcctaaccaagtagacaacttaagcacctaaggcagaatgaaagtttctctcttgtcattaagtcctctattcaattaccatttatcggggtaattaaacactggaaagtgatgccaggctaattgttagattatgataattacacgtctttgctatgctacagctgatcaaaataagatgtggtcccgtgcacttagccaaagctgctctgtaatcgtcagacttttgtacagtgctaggacatttattactaattcattacaaatcaggcggagaagcttattatttgtaatgcttctaccccctacccccacacagcctcctgaaacaagactcacaaaaggttaagcacaaacttctgcctctcattggcccattgccatcccaattacacagctgaacagcattaggtgcctctatttgagagggttcatcaggctgcttcacaaacatcctgcaatcgcctatcacattggcagaaacatccaagaccccttttcagcccctgccaaccactgttttgctctcagttgtgtcccagcaaccatgagctggaaatccagagactcctttggttttggggctccctcctgctcaggtcaggcctcagctagactgagatatgtccaggggtttgctccagttagcaggagtcatggggaatacagactgttctccacctacctgacatccagtctctgttcttcaagctgggatcaggagaggaaaccagcgttctcaggctcccaccagagtcaccacaaagctaccaaatagattcggatctttggagagaaagactagaaccaatgcattgtccttgggctttacaaggccagaatccctggcatatctgggggttagaaatctctccttccatccctgtactaactgctccaggccactgttggaaggtgggaaggcaaacaggtattttatattcttcacttggctttatcctggaacttttgaggtcctccctgcaaccatcatcagaatgtgttagcatgagccactgtgaggtggaggaagcatagagcatcaggttaaaagtttagtaactgctacatttatgtcatggtatggctctctattttaggattttttttctcttattattttagcagtgttacagactgaatgtctgtctctcccactccaattcatgtttaagccccaacccacaatgtgattgcatttggagacagggtcttttttggaagtaattaaggttaaatgaagtcacaagggtggggccctaatccaacaggattagtgtccttatatgaatagcagagagctcattctccttctgccatgtgaggactcagggagaagatggctgccccaagagagccccccaccggaaatcaacttctgctagaccttggtctgggacttctagcctccaaaactgtgagaaaataaatctctgttgtttaagccacagggtctatggtagtttgttatggaagtctgagcagactaatatgagcagtttaacattaaattagggatacagtgggggatagggtggttttgaattacattgctctcagtgacttcagatgtatataaacatcaataaagaacagctaagtaaaaatggccagaaaggaagggagcaagggggaaggaagatggcagacttatgccactaccagcacttctcatgataccctgcacatgggagagactcagcatctacttgctgctctgagcaaatggctgctctgaggcgagaaggcacactatttttctaagtaagcatagtttcaactctgaaattaactcatggcactacaaaaacgactgtattatcacctggcaactgtgttatctcgctgttttagcaaaggcttttgcccagagatagaatgaagggtgttacagaaaagtcacatattccattttacctttccttgaccctggaaattaaaacagaatatgccaccacccttcaacaattgtattaagtgcattctaggggcaaaagaaaccacgaggtactttgttaacaccagaatacatgaaactgtcatttcatgcacacatttattggtggcctgtggtttagactggggaacaaaggtacttcagttcatcacataaaaatggttttgcactacttagtattattatttcctccccacactcattaaaaggatatccattcatacagctggatcctctatttacttttatagcctggaccacagaaagatatatgcaagaaaaatgcaatcataaaaaatgagaaactaattgctctatcccaaggaaacataagcgggagaaagaaataaacaattcaccatttatttctcagaaataaatctaagcactttagaggattctcaagtactacaatatttctacctacttaaatgcttgtctatctcaatgacagagaatatagttgtttttctttttccacctatcatcttaataaactctactttcaaaatgtctaccttggaaaagaactatagttcaaagggagtgcacatgatcttcctattgaactttcagaatttttggtattgccagaagctctgaatgagccacttgtgtggactgcaaggtttctgaggcaaggttaatgtcaagacacaaagacgatgaaataagcagatgataatgggcactccatacccatgaaaactcagcactgtcagctttgagaagacagggtcacaacttactttcttcagtactcagtagtgcaatcccagatcccaaagtttcacgacgtacacattaacattttattgctgctcacactgttcaaggcagacagaaagagagaatgtgagctgtttttggtcacaaactcagtgttgatgagctgggtcaaaaaacaacacaggatttacaaaacctatgggagatattaaatgagcctgggactaagcacagaatctgtatgctatgtgatggtaaatgttactctaatatagcacgtcaattgatttatttacagaataggataattttacttgttgatgttttaattcaacatctgggtatctaccttgtacatgccaaatatttatcaaaatcataccccattttgcatgctaaaaaaaaaacttggattttttttttttttcagttctacaaatataaagtattcctttcaaccctctctctgagaagtaaaggcatagggtaaacagggatttcaccttggtatatctcagatttctggctcaggacactctgtatctgagaaagattcacaacagccaaaaccaactcaaggatgtttttaaatccagtcattaattaaaaaccctaagtcatggtcactgaaagtactggttactatggttctataaacgtgattagggaaaataacatgacatgtgctggccaggtgagcagattagaagcacaatctaccaggctaatataaagagtatacccactcttggtgctgttaaacctgccctgaagcatgcactaatattcagggctggagcaaggaaggatagcgtcctatctgcagaaacaccttttccttccttgtgtaggcagtgaagctgtgctggaattgcatttcccaccatataactgggacatgatctgaagcttacatatacttcagtttagttctgaatcctaagaagttacaaattattccaactcactagaggaaatgaaaattaggagctgtgggaggtgcctattgtttttctgttttagtttaaatatgaatttctggcataaaagctgaagaaatatacttacatatgcatagcactttctggtagaacattaaatttagtttattttttaaataagggtggtgccttctgaatataactaatatctctaaagatgtcagagatgtttccaagtatatggaaacaggaaatactgcatttctttgacaattaggacatttaaaaatttgtatcacatgtggaaaattgtgttgattctaattatgaaaaaacttactggacaactcaaaattagacatatcactcctgattttcttcgaatctaagaaatcctcctacataaaacttttgataaaggttttgactcaacaacagctacaaccatcttactagagttgagagcaacaaaatcctaactcaccactccttgaaaacaccaggttatttgcctttgtattctagaccaataacctggctttgtatcctagacactactgatgttcactagtcttaacctacagtaattatataaatatacacagcatgcatgacatcagcttgcaaagagatggcctttttttttcccattgatacttagtcttaataatttcacaagaaccctacttcggaatcaagactatagagagatatactagtaaaataaagtttgagccatcatcttatccagctgtttccttttagaactcttaactacctagtttctttttttgaaaatctccaggggagaatttcattctaaaatagtagttctttcccaggacctatagatgtcattcaaaattcagtacataaagaaattctcttttcaagggcatccagctttccagtgtagttcaaagcaatcccctcaaccctgccctgtaagaagatttgagagaaatgtatagaaaatgtagcttatgttttcctaggaaagttgagctgattgtattatcaactgtctattgcattagcaatttccagctgaattacaaactgtttccctgcattatattgctattgttcaatatcattttattgccctaatgaaacaaagctatataatataaccataaagtactgattacagttaaccataatggaagcgagctaaggaaagctctatttttaaaataagcaaagaaaaagaagaaatgctgatactcagaagacttttttttttctctttttggttttctggattgggatcaaaacaacgctgacaaattacttcttctttctcttccaacaatacagatggtatttccccccaagacagaatttctagaaaacttcccgaggagcgaaagttccccaggtactaaaaaaaaaaaaaaaaaaaaaaaaccctgtgaattataaatatgtcttaaaaagtacctacctcaaaccagagtattctcttcatatcatggaagaagatatccaaattttccctggggtacaggtttctccctgtctgtagatgagctcttggaaaagtaccattatgaaaccattaggggcattgcttattggcctatattaaatcgaccagcaacacaaatgattaggatgctgtgctgggcaggaggctgcccaaataagatggcaaatccatagctaaggtttctgccttttagtaaaggcaatgaagatgacttggcagttccttatatacccagctccttttccatagatagaaccagtaaacaaagagttggaaagaacaggcaaaagagaaatttcttgggtgttgctaattaaatgatgactataagctgcagtgccaggcacttgctgtcctctgacatgcatgccagacccactataccccctcaagaacagcataattagagcaagggggaacagagtatcattccccaagcatttcttgtgttgaactggagacagttaatgaaactactgtacagtgctgtagtggcagatgatctgtgactgccctttttctaggcgcttaaactttcaacatctgaaaaattcttcttgccatttctgcagtagatatggtgtaaatgccacatgttcttactcataagtgggaattgaacaatgagaacacatggacacagggaggggaacactacacactggggactgtcgggggttgggtgaaaaggggagggagagcattaggaaaagtacctaatgcatgcagtgcttaaaacctagatatcaggttgataggtgcagcaaactaccatggcacatgtatacgtatgtaacaaacctgcacgttcagcacatgtatcccagaacttaaagtaaaatgtaataaaataaatttcaaaaagatatggtgtaaatgtaaagtacacttgaaatgcctgaatgtcaagatcagagactaggtcctccaagacaaactctggtaatggaacaatccttattcttctagagatctttggtgagtattcacattatctacgaggaacgtggatgataacatcatccatgtggacacagcatgctgagtgctacatactatatttgatgcactgatctgatgtaagtggttcagaacagtttccgcaatgctcaatatacttgcattttctcatttctgcacccctgaaaaaagctaaagataaatcagggtgatatctgttagacctctttcaatagtgtgtattgcttgaaagatgaaagagaacatgcatttatcttttcctattagagtgctaatttatgcaagttcatttgccttttgcatctattgattggattcttgttgtctcatcccctgtactccattagaatcctcgctgacttaacaataatgcaaaggcagacaaaatttgtacagatttttacatgctcttgcatctatagcctatttaaaagtttgcataagcaagacagtgtaagtagaaattatgggcaacatgaaaaagtatttcacatcattgcatcagaaagaaaatctcagagaagatgagaatacttaatggttgaacttctcttttcaattttaaatagtcatggctgaacatttgaaaagaatcttgtgcttcaggcatgccgaaattaaaatagaagcgcaatttgagattacagtttataaaaccagtaagcacagctgctacatgtaggacaggaatggccctccttttccaaatccatttgtgtaagtcaaacttagaagtaaaattttctttactatgaaaactggcaaaaggacacagccctaggagaataattttcagacatggtttcctatgaatttgctcccagactcaaagaatgcttgatttcctgcttcattgggaatatatatacatattaattagtttaaatgcttaccgtttatggggtcaaaatctgattttagttccaggaataatgataaaataacttatttaatattaagtgacataaaagctgataatcataggacaagagtataaagattgccatttaaaaaaagttttttggagatagagtctcactctgtcaaccaggctgcagtgcagtggtgtgatttcggctcactgcaacctccacctcctgagttcaagtgatttttgtgcctcagcctcccgagtagcttggattacaggcatccaccgtcacactcggctaatttttatatttttagtagatacagggttttgccatgttggtcaggctggtcttgaactcctgaccacaagtgatctgcctggctgggcctcccaaagtgctgggattacaggtgtgagccaccacacctggcctcaaagattgccatttgagatataactttaaaccccaaagagtattttaatgcactttgtacagagcacatatgtgctctattgaagggtttataactattccttctggttttcacttcactatgtccaaaaaggaagagggaaaatgtaaaagtccagtgagaatctgatctgttctcatcctccaagtgatttatggcctcagagacttgacaatggagaaatcgcaagatgctcacaagtcacgaaaagggaggcttctcagcttattgaggatgctagagttgttcaggcagggatgttcgacagaggcagagggacacctagcaggtgtggagttcagccacccagacctctccaaggatggctgcaaatagcacaagatgtccacgaacactaataggcgtcctctgaaccacttgggaggtgtcactaataaaaagtggaaatcaaaatggaaagaaaatttcacctctaatccttcttgtggcacctggctttttcagcacatatggtacataaagtttgttaatgtctggtagttatcgagtaaatcagagttgattaaagatgtttcaactttatcttcatttttcagactttatagacatccatctgataactgagaataaacaactattttattggttgtggcagacagttcaggaaagaggttaagagaaaggaatacacagttgtctgcctatcttcgaatctgggctctgctgctactaactgtgtaatcttggcacattccatgacctctccacatctcaggttcctcacctgtaacatcagaacataacacctcactcctaggacatgttaggattaaatgtataaactaaatgaacaaataaatgatgactaaaagtacagtgctttgtacagtgcctgacaaatgattaagtgctcagtatgtattaaaacaaagtaagaggaatatattcaattatactatttatggaacttttagggtattatttttaccactaaaatgaattttaattatttgaaaagcatcctgagaatctcaaagatcctgcaaaataaaaatttcaacagtcattattacatatctttagtaggtagagtgtaatttttgtttatgaagaaaggaaatgtgatttctaaaactttagaaaggcaggacctggtggcttacacctgtaatcccagcactttgggaggctgaggcaggcagatcacgagatcaggagatcgagaccagaccatcctggctaacacggtgaatccctgtctctactaaaaatacaaaaaattagctgggcatggtggcgggcgcctgtagtcccagctactcaggaggctgaggcaggagaatcgcttgaacccaggaggcagaggttgcagtgagccaagatcacgccactgcactccagcctgggtgacaaaaaactttagaaataaaaaacttaaaaaaataaaaataaaaacttcagaaaatggggaagaagacactgactttctcaaggggactgtctatgcactcacaaagaaatctcagtcaccttctggaagcatgcaggatatataaatacacaaaggaagggtgggcagttgcctctgtgaggtaattctgggacacaaaggccatctttaaacaaaactgccttcccaaaagtgaatgtcaatccttaaatatgtgtaaaatgttactttgcttgggaggaaaatcttacttgccagctaacgcattaacatattttcatctctctgacccattaatacctgtcacccagcagagttaagacccctgagagactggtgaacacagtgggtaagtttttatgagaaaggggcctcaggaaaggggaatcagactgaatgacagaggtacagggtgacaacagaggaacactgagactttgcaattctgctgaggtcagctcaaaagactaagtgtcttcacactgcattagactaaatgatgtttctctacaggaaggcctgttttaacttaaactttaaaattacgcatttgagcaatatgatattcgactgaccctccaacctttcctaatttgattgacttttcacatatttatgtcctggctcccttgttaattaagtaattcattcaagacaagtatattgatagcctcctgtggctcaggctttgtacttaaaggtggagaaacagaaatgaaccaagacatagtcctgccctggagaaactgacagtctagtggggaaggcagtcatccaaatacatcactccaataaagtgctataaatgtaagagaaacgtctaccaaatgctgtagaaaatagtaaacagcaaaagacttcaaaagagttcagaaagaccatacagaagagccagcacttgcaggatggacgaaggggaggggggcttctcaggcaaggcaaaatgtacagacccaaagaaatgtgaaagcaaggacagtgttgacagcaaatgagaccaccaaaggaggttagaaccttattttgaaaaaggagtttgacaggcaattaagaacaagggatttttttttttctttttatttcccccctctgagatggagtctggttctgttgcccaggctggagtgcagtggcacaatctcagctcactgcaacttccgcctcccgggttcaagcgattctctgcctcagcctcccgagtagctgggattacaggtgcctgccaccacgccgggctaatttttgactcctaacctcatgatccacccacctcagcctcccaaagtgctgggattataggcatgagccactgcgcccagccaagaacaagggaaaatttttaagaaggtgcagaacatgattggatttgtatgttaaagtgatcactctgttagtcctggagaagacagactggatggagagaaagctcgaagtagtaagatcattaaggagtctactgcattagaccaggcaaacaaacacacagaccttgccagcttcagctgagaattccttactccctggcacctgccagtaaactattcacttattcttccattaaacgactatttgtagaggccctattgaatgctagatactggcactgtggaaagctacaaaataatacacataaaggcttcacttcagcttcttatgactgcatagacatgacaagagcctaaagtaggtcatttgtgggcttaaggaaaaggagatggacaagagaaaagttacacagagggaggaacatcggaaggttaaaaataatccccagggctgggcgcagtggctcacacccgtaatcccagcactttggaaggctgaggcgggcggatcacgagatcaggagttcgagaccagcctggccaacatgatgaaaccccatctctactaaaaatacaaaaaattagctgcatgtggtggtgtgcgcctgtaatcccagctacttgagaggctgaggcaggagaattgcttgaacccgggagatggaggttgcagtgagacgagatcatgccactgcactccagcctgggtgacagtgtgaaactctgtctcacaataaataaataaataaataaataaataaataaataaataaaataaaataaaaacaaaaataatccccaacatttgttcattattttgcagctcttacatatcaccatgaagggcaatgtggggtgggttggagtgggggtgaaggtctgaaagagtagtgcatgtgaggttaaagacctgggtttaaatacttcccctatacctcagtttttaaataaataaatgaaaaataaggtgtcctaaaggttctataacactttcagtttcacacatggaacatgcagaaaatagtcaccacatatttggtgactgaattatttcagaagccaaatgatacgatttagtggaacactgagactacggctaattctgctcctggatttccattcatcacatcaatttcaacaagtgaagagcagctataaccaaatggctaaagctggcagagtgtccaacgcctagaggcacaaggaggtcataatgattgtctagtgactggtatggaagggtggaagccaaaaatatggctaaaaccataaaaaaaaaaaaataaggattctactcttccctgatggtaagtggcagaactagggacactttaggtgatgacaactaatagaaatgtcaccatcgatgaaaagctacaagagaagatgtagcttatcacatcatccctccccgcccccccaactacacctgctctgaacccttccaacagccaaagcagcacaacaggaaatgacaagtataatgatgagaaaaaccagtgaggtcaccatttaataattttccccaagtattttctgcactgtttcatggagtattgtcacatccaaagtccttaagaagctctctaagttccaacattcctgacagaggaatataaataaataacgtacacttaatcaaaattgttttacacctgctccttcctactaaaaatgatagaaaagaaaacatctgcattactgtctctggagaagtaaacttttcctcttccaaagtcttttgaagggtaatgagatgccttaagtgcagggaaaatttaagattttgtccaggtctgaaattgttgacaatatgttaagcagacggaggtgatttcttttgtttctctaactttcccttttggttctgatgaaggagatgctgacataaatgtttttgttgttttgcatggcagatagacttgcacatctcaaaggggaagcaaatcatctccttgcaaacgatgggttatttttgccaaaaaatttgtattaacgacggcagaaagccgtgaaatatttatatgcctcgacttccacatgagaaggaaggaggggagttgtgagagagggaacgggatatgccacacaaaaattttttggtcattttgattcactgaaacaaaatggctttttaagcaccctgggacctccacgtgtttgtttaggattccaaaggcaaagtttttttgctcctctagatgacagcaaaatcttcacttccttgaaaactggtgctatcagcctcattgtgacaagatttaagtaaagccacagaactggaattgtgaaatgcctcctgccatgctccctctcttcccttctttctaaattagttttgtcgactaatattttctcctcctagtgtccttaagcatgtgcaaagcactaattcacacataacattcaagagcgcctaatgcctcaaagtattgctcagtaactccaatgttttttctacttttgctccaaaaattttgtctataattgataaaagcatgaaacactgagcaattagagggataagggtgaaagccagggcactggatgtatgtggttcatccactaaatacgccaacaaagtatccattatttcacatgaaccagactctgttttgtaagagacgctgggggtgtttagaattctaaaattatatggtattgttgaggtcagtcagaaaccactcaaaccaatgaggatatgagagttatgcttatgtgtggcaattcaaatgtaatattaaaaagtcacagtgctttatcatttatcccatttcttaagagaacaaaggcaatgattctggaggcttttcatcgtctttagacaactgcaagaaactgagagctacgtggtcttggcatttgatcctgaaggttaatcccttgggaagtcagacagctttctttgcaatgtctagaggaccacactattctatagcataaaagctggaggtcttaccaagatggaaaacgttaaatatagtttattagactattaaaagtttatgacatcacttccctattctctgatattcatcaataaatcccctttgatctccacaggaatctcagcgtagcttcttgtacagtaatacctatgtactcaagcttcaaagatccatttacttcacatgtgtaatttgcccacttattcctgctgagataatacccttggtttaattgcccatagagcaactggataaatcaactacgttggtttgtattagctgtctatgcatatgtgtaaagcaaaaataaataaataaaaagcaagactgttcaagtcattaactgcaaaaattagaataaaaaattttttcctaagagccacaaatagactcaatcagtatttctaaattttacaaaatgaaaaaagtcctttaaaaatatacttggagatatcaactacttcattgttttggaggcagagaataaataatctcagtatacatttagatagatagacagataatctataaagagaaaacgatggtgaatagatgaatgaatgaatgaatgaataagtgaaaacctaaatgaatgagtgaacaaatgcatagaaaaaagcatataaattaaacaagcctggacccacttaagaaatgtcagacttatcaggaaacaataggtactggagaggctgtggagaaacaggaaggcttttccactgttggtaggagggtaacttagttcaaccattgtggaagacagtatggcgattcctcaaggacctggaaccagaaataccatttgacccagcaatcccattactgggtatatacccaaagggatataaatcattctactataaagacacatgtacacgtatgtttattgtagtactatttacaatagcaaagacatggaaccaactcaaaggtccatcaatgatagacaggataaagaaaatgtggtacgtatataccaaggaatactatgcagccataaaaaggaatgagatcgtgtccttgataaagctggaagccattatcctcagcaaactaacacaggaacagaaaactaaacagcacatattctcactcataagtaggagctgaacattgagaacacatggacacagggaggggaacaacacacaccagggccttttaccggggttgggggtgaggggagggaacttagaggacgggtcaataggtgcagcaaaccaccatggcacacgtatacctatgtgacaaacctgtacgttccgcacaagtatcccgttttttttcttttagaaaaaaaaagtcagacttatacagctgacattaatttacagaaattcaagcctattttcacttaatagtcagcactatgatgaaagaaaaatctctttataggctgggcacaatggctcacgcctgtaatctcagcacttcgggaggctgagactagaggatcacttgagccccgaagtttgagaccaacctgagcaatacagtgaaaccccatctcaaaaaaaaaagttaaaaaattagccgggggtggtggtatgtatctgtagtcccagctacttggaagggctgaggtgggaggactgcttgagcccaggaggtcaaggctgcagtgaatcgtgattgagccactgtacttactccagcctgggctcagaatgagaccctgtctcagaaaaatttttgaaaactcttgtatacaacaaattattatatcttatgttttaaacctttaaagagtcattttctacttgagcttctggttattacattacatacctaggaaaactcatatatgtacagacatgcatacacagaaaggcttaactccaaaacacaaaatatttcagtaaaacaccttaatccttcaaataagtgaaaagaaaagcttgcctggcctgatttctttctttcttctttttaaaaaagcttatatgaatgttgtatccatataagaataataagccctgcattgttttaaataaatctctatttgatcttctggcttctttctaaagacactttacttctcaataacaatacactatttaactggatattgaaatacataaacatatattttattacaaaaccctagaacatagtcacattctagatggagttctaaaactgacagaatgttcagatagaaagatgtgaaggctatttagacatattagatattaaaagaattgataaaaatcattgcttttttatttaaaaacttcctatagttggtaaagtcagacaatgaccaccagaataatataataaataaatcttatattcagaacaaaatttatttcatctgaaaaatataaaaatgtattattaccaactgggtcttatgtatgtcattctgatttaagtatagcttaaaatatgctgagcctattatatatgggactctttcttatgcactctatgtatattcattttacatgggaattaaactctataaattgagttctacaagtgcataagtacagaaacaaatagaaacctatttataggtaattgatttcatgatttttggagttgactaggtgatttttaagtggcactagcaatgaggtctgccaagtttctacttttgaacatttctataccttgtggtctcaatttaaaatacatgagaaatcacaaattcaagcaatgccagagatgaaaggaagaccttagcagcagcaggtggagcggaggaggtattattgaaatacttgttgatatgattcaagagtgctcaaggccatctgatgctaagggccacaagcaaaatcagcagaggcctaacctgactaattgtctcccctgattgtgacggttttgattagaagaataatcagctctcagcagcctgtaggcaaaaatgcaaactgaaggagtgtgagtgtgtgtgtgtgtgtgtgtatgtgtgtgtgtgacagatgcatagcagaatgaatgccagatcaatattaacccactcttaaaacattaaaggggttccaatatgaacaaaagccaataattcccttcatagctaactagcatgaacgtttttccttctgtcactttataattgcttttatacaatctaaaggaaatgctgatattcaggctttccaaaagtccaaatgcattcatattttgtcactgaaaattgaagtcatacaattctacaagtcatttttgagtagttactttaaaatactttatattaaactcaacaagacatcgttttaagataaattagtaacattttttcttaaagcttttgctactatttcatcaatatgttaatgaaaatgtataaaaattatacctttgtttttaaaattaagattaagaatatatatttaatcatccaaaggactacattaaaatcagctgtaatcatcatttgaagctttactttgtgattgtctgcttcttttttcagatgaccagtctctcagttttgtgcaaagtatcttaaacttagactaaatggtaatttacttcaattattattcctacattagaaaattttaaatctcaagatttagaaatttaaacttcctgaagttattaagctcttaaaggtgaaagtttggggaaattttataatatgcaaatactaacattttttagtgcccataaaaaagctaaggtcatttggttcctgtgagaatgtaaaatgtatactttatttgcttacaaatgtatcacatttagtatatttagatataggcagggagggaatgaggaagaatacatttcagaaaaaaatgtataaatcttttgtaaattgtatttttacttaaactttctttccactgtggctatgagagaatgagagggaacaagagcaagagcaagtagagagggaaggaagcttttaggtctgaagagttgaaactgggttattttaagctccattccatgaacagaggtggttttatcttcagctaagtgtttaaaggcatgtgataacactaaatgcagatttccatctacctgctggactcaacaaaatctcaaaccctcaactggtgcctccaaatgtaactgtcagtcagctgatgtcaaaacctaacgtcttttccatggccttacacatctggtccctgtcagtgtcaacgaggtttgttggatgtggtgtcatggcaggcaaatgatttatatacacagacccaaagatctcagagctccttcagaggatgcatttcatctggtgtacttgccatcaacaaatgattgactgaaattaaacaaaaccttacatcctgaaacgtgagcattctctactccccctcttcactcggatcatgaatatatttagttagccagggagttcacaaaagacccatgtcaacagtctattagtgagatagaaaaaaatgcacattaaacacctccatgctttagcctctgacctccttaagctggcacatttttaaaattctttgtgggataaggaattactaaccagccacactggaaactcaagagtagctggtgatcaagtccacccagcattttcctttgcaaatcttcagttgagggaagaagaccttcagaagtgagtgttgcctttatcaaataaattacctaaaatactgcaccagattagaacaacagcaaaaaattcctcattcttgtctttaacctctcttatttcatctccttaggacaatgcacagacatgaggcacccagaatgtctctttctttgctcttaaagtttattgttgcaacctggttatggataattctttccactttactcagtgtgaattattctttttcacaagcctcataatgaactataaaactaacactttggtccagttagcattagcatatgttgagaacaactttaatgcacagctgccctgactgggtgcagccaaacttctgattttgagtgcttcctgcaggaaaatgccatccactacctagaaatgcttcatactctgctgttgtttgattaacagttttagctttgacagacattaatacaatgttaaagatattaattgtctcttaacttagaactcttaattgaaaaagaattaggaacctggtgaatggttacaggtccatattccacatggagagggctaattaagagctctggggtgatggggtggtggcttagctcctaaaaggaggtgtccatatatatcaatctaaagttaatttaacctaagctaactagggtgtgatttatatttttatcccagagctctaggccatttcccacagctctctcttttaacatgctgaaacttgcttaagcactgaaggaagaaaaaaagtaagtaatgattgtttaggtaatgttagggtggtgcagatcagctcttgaagaagccagctgttcatgcactgtcatctatccatgcaggcttgttcaaacatgcaaagcaagtgggctacagtgctttccatctatctaggtaaaggtgtaaaaagtggcatgtgtagaagccagcaaacagcagcaaaatcttttcagatcttgctaagcctctagagagctgaaaaacattcccttttaagagagatgttttgaaaccaagtgctgttgcaactgtgccagtggttggggcatgtctctacactagttgaacaaaccacacttgtcccagcaaatcatctggctttgctgctgctttagatggggctgatctatacccttttgcatctctaatgctcacctcctgtccagatgagctctctggtctagcttgcccccttgttcaatatggccatagaagaaatttggggaaggaaatctgatgtttggggtctgtaagcccatttcctttataaatgctatgctacttatctagtcaaaatgcatcccaagaatctgcacaaccctgaatgttcattctgacccttagcacagttgttctgctagtgtacactgcttcccttcacgcttactgttgtgttcttagtggggaggagtctcttcttgcaggtcaaactctgtacctctttcctctttgcccaagattagctgggcccacagggtcacaggccctccagtcaacctaccaatgaacagcctcagtggcccacttaactctaattgaaaggccccttttgtcatttttaacagatgtaaagtgtgtgaatttaaaattccaaatgctgttaatatacaactcgcacaatgttttttgctttaacattcattgctgacctgttatgatctaaagttctccaaaagaaagttcgtgttaatactgcactccatagaggtggtaggaatagtctctagcctgatgaaggcactctagatccttgactcagcctctgaaggtctaggacctcccacagtaccaatatccatgaatgcttaagtccctgatataaaaaggcatcgcatttgcatataacctatgcacattctcctgtatgctttaaatcatctctagatttcttatgatacctaatacaatgtaaaaatatgtaaatcattgttatactgtattgtttagagaataatggcaagaaaaaagtctgtacatgctcagtacagacactttttatttcaaatattttcaatccaaggttggttgagtccatggatgtggcacccatgtataaggagggccgactgtatttactttaccatgttatttgaataagttacctagtttaaaaaaatagctaataataaggaaaagtgtgagcaggagagagaatatgggaatgctctgtactatctgctcaatttctataaacacacaattgttctactaatttaaaacaaaacagcaacaacaaaaacatagtgatcctctgaattgcttcacataggagcagcaactatgttcacttcacatatgttaattcgtttgctccttaaaacaactctaagaagtgggtgttgttattttcattttgcagatgtagtaacagacaaagagagattttagaacgtgttcaaggtttctatagtggcaccaagattcaagtccccttatctcctcttccaaatcccatgctgttccctctaaaccacactattttctactatacgttgatcatatcatatttattgttgggcttggctaccagtcagagctaaatgtaatgctcaatgagagtaagatactacttttgatatatttgttttctctgacctctttacagtttttacagttgttataattatttgaacagtttcatctgatatgcctttaatcagtcattcaaacaccttccctgagctttaactatgtgctatgtatcaccttggactgtggggtacaaggatgaatagaaaataattcctttcctcaaagatttcggcctggtcagggggacagacccataaacttgtaattacattttgagatgtaaaggtgggatcccaaatatagccttggagataagaaaaggcttacccgagtcaaagtttgagcaggagttatctacaattggcagaggcactctagataggatgggcagcatgaggaaaccaaaaggtacaaaggtgagaaacaaggtgcctggaacctggagtgctaaagcctttttggaagtcgtgagacaataaactgcagttataaactagtacatcattataaaaaaaaattgtgatacagaaaacagagtgctgaaaacctccgtatgggtatcctcaattatttgcttaaatcgtaagggaaactatgcattgaaccgctgtctatctcacaacaccatttaaaacaattgttacagtaaccaaatcacttcagtggtttttaagaagtattttcttattgtgtgcaagagaaactttaatcatccattgtacatcaggggaagagacagaataattttagtctttttttattgaaaacttcaggatattgctgatattttaataaaagcagtctagatcttttttgtttgttgattctctataaaggatttctaggcacaaattttgatttttgtaccttgacaccaaaatatacttttccataaacgtatacctgacaattctttgttctttaacttaaggagcatttcttccttcaaatttacgtttaaattaactgttttattttaggacctcaaaatatcaattggaggctactggctcacgcctgtaatcccagcactttgagaggctgaggcaggtggatcacctgaggtctgaagtttgagaccagcctggccaacatggcaaaaccccatctctaccaaaaatacaaaaaattaggtggaggaattgggaatagcttgaacctgggaggtggaggttgcagtgagttgagatcacgtcaccacactccagcctgggtgacagagcaagactccatctcaaaaaaaatcaattggaacacatgaaaaaaaaaaaaaagaaatgtagaacaacaaagcagaacaaaggctagaactacagaaaaatagatggttaaagtgaagtgggcctgaagatcatttatcctatgttcatgttttatagttgagtaactgacacccagaaaggtgaagtcacttggctaacattgccaagttcattaacggcaaagctcagagtagagtgaattcctgaattccaggacagtgctgcaaaaattatctcctggagttctgtaaatgtaaaaaaaattgaagaccctgtgagagttgagagtttcttcctctgctccacaggagtggaaggaaagtggtcagaattgagttgtcacgcaatggcacagcagaagaaaattcctagcttcaagcaatgattggtgagttcacactgtctcagtggggcagcaccacctggaatctcatatgaggaaacatcagatgataagggcagcttgactggagtcagctttaatagccttaactttgtctccagttgccaacaaacagcagggtcagctagacagcagcagctacaggtggccatcaccacttcatctctcttccactctgcacgcctcaaacgcttagccttaggaactgtttaaccactgcagaggtaacatttttagggcaattttggcttttctggtttaaaatcaggaaaggctactgtgttatacagaagatgactgtagccaataaggaattccatgcaggaatggcctactctgctaatcaagaggtagggaccttttctgtgccctcatttaacaatctgtattggaataaaagcagaacatatgtaaaggcttggaaagtatctcctttttgattttgctgatgccatcctcatattgatgagacgagaatttttttttaagacactaaaaatgaatttaagacatggatctagcaccatggagcaaaggattatcggccctaaccatttctgctccatgtcttctattattgcctgctgactatttctgctcataagggaccatgaactatccatgagtgcaaaatggatacagcacaaattgattcagtaacatcacacagacacgtatgaataatgaggctcagttgcagtctgtcacacagcaagcatatcagtgtagctgatttatcgaaaacttgagtgagtaaagcctctttcttaaggaaggtatcagctgtttcttcacttttttggtaaaaaataaatttgagcaaactaagatcttttgtaatttaaaatgtgagaaaaaaaaaccctgaaagtagctttcactataactgacctacttctgatatcttaaccaaaaaacagaagagagggagaagacaaatggtaccaacgttaccataaaccttaaaggttcatcagagatgctaatcaatttcaaattccctaaggaaagctgtgtctttgcatgggcatctatgactgctagaggaatatgcctatgtcattaaaacaagggaaaataagcttgttattagcacccctcccctttagaagaatatcctaggatattcaatgagaaaaacaaaaggacacggtattcattccacatctatcatgcaaatacggtgggtgtagctatcaaaaccaaagagaacaatcacagcctcaggcacaacagtccagcatctctgaaacttgccctgtatttctttgtgttttcagagtagggaaatttcaaattctgaccacatgcacatttaagtaaaagaggtaggaatcagactagatgatgacccctcctatctcttctaattcccaggttccaggagaccttgaaactcaaaaataaaaaagcaaaagaacaaagattaagattttcctaaaaaagagagactacagtaaaagcatgtgttaaaatatccataatcacaacatctaagcagttttcagatgaagcaaggacagagaatatacacatagagacagaacttgcctaacagtagagagaaagctattcagtagaattctttaagggcagcaaggtaccacttagtaagtcactgagttcaagccccaaacagcatctttgggaatccagccgatatacccctaaagagaggcccaatgtgtcagacattaaatatagaggggggaaaaaaagaccttttctacaggttgtaattgaggcaagagaggacgggggagaaagactgtgatctaagcaagagagaaaaggggaaaaccagcactcaactaaatgaacctagatcagcttatagatgcagcattgcttctgtaggtcaaaagtgttaattttatgtgagaatagcaaaagatcctgttattacctctttaaacaaggcattatttttaaaagtgaggaaaattaagcaaatccagcaataacttgattaacctatttagtcatgttggttcataaagaatcaattatttaatataggcattgagtaaatttttttttaaaaaaagcatctgtaatttattcactggctctagggatatctctggaatcaaagacagcttaactgagttatgaagttctcaccaaatacttgtacatgttttcaaagggccccgaaagcagcccggtactttctgcttcaggctacacattaactaaattccaatgtgccctgcacagagcaacctcttcatcaattatttcctgcaactcttcagaatgttctttttgcagcatgtgtggttagaccctgggatcactgtagaaatccagaaaatgccaggatgcagacggacagacacacacaccccacgcaaaaacgccaaggtcctaaaactgcatgaagttgtcatcttcactgcaaagagtgaagaactgagaaagatcagaaaagctaaggaggatagagtgtgcttgggaggaggtttgctgaagaaaagaatcagcaagaaagaaaggaaagaaaagggaagagatgagcaaaaaagagaaaatcaaagatcatcttttgtttatataaatagcttctggattgtgacttttatttgatgtcaacaacaaatgaacaaacaggacaaatgctgtattgctgaactgatagcctcatgttaaatagaaacttttctccagaataaacaccatagtgcagaaagttccatggtaaacggctatgggtccacactatgagttagacctaaagcatcacacacagcatggcccttgtagagctaatatgttctttcattcccagaattaagtcactagtccaatggaaacactaaccctaccaatctcccagagactttgtgatgaacaaaacataagattagagatgaaaacacctggcaaaatgtaaagctgcaccctgctatgtgggacagtgctactcagaatgcctgttccccaagatggaaaagcatcacatctgtttaataagcaactcagtggcctcagctaaaccaagtttggttctcttcttcctgacactcccaaatccattgtatgaatggttcacacctttttctttgtgctaagattctaaggtttatgaatctgaagttcattcatgggaataaggagaaataccacacagtgatttgtgctggaaagaaaacacagcttgctagtgggcaggagatgtgggttctagtccccattcagtcactggcgtccatcctgatgctgaatatgtcatatactctccagggttcagtttcctcatctatgaagcgggggatggagtagctgagattagatagagaggcaagggcagctccagttctatagtctttaattcaaagttaatctacttttatttttgctctaaaatctaaccacaaccattctccaaagattttgaggtaattcagtttgatcatttttccagtaaaataaatatcatatcactaaataaaaaagcagattacaatgaaatatatagaataattttaatcatgttaacaaattcacacacatatatttcatactttatatataacatattctggatggtggcattataaataaagttcactttcatcagtgtactttaaaatatatatatttctgattttcctcaataatacatttattttataatcagaaagatagcattagaattaaagagccaaactactacacctgatattttcaggactgtcttccaatatttttccaataaaaactagagacataggtacatatttgtgtatgtgtatatgtaatttataaaacactcggattcagtaagaaattgtgatacttggtaaaaacaattgatctaaacaatttagagagtaaataaagaggaattataagaattctgataatgtaaattcagggcacaaaataattaaaacttgcttgaattaactcagggatgctatagctataagaattttcttataatcactttaaaattcattaagagtgagtgagcttttctgtatttttccatatgcttccatatcctctttttccatcaaatgcagtatgcactttggttccttgtgagtgaggacaatttgaagtttctaatgttgactccaaaggcatgaagtcacactcaccgagctgcatctaagtacctaactgggaaaatgttttgtgtggcatcaagtacctcatattagatcacagtttactctgtatgacagcagcatgggaagtgggttaaatgcattaagaaaataatttcaaagcccaggagagcttttgggaagttttactatgaatctttaaaccagaagcaatgactacagtgaggggacagtaggaatttcatgggattcaaaaagaggcagggaaataattgaggcacaccctgcccctaacctcctaacctctggagtctgggctggctagaattcagccccgggaccagcagcacttcagcaatttagcaccaaaaggaagctttggtccactctcctgtcctccaggggtatatgtctcagaatatccctccaatcttcactacccttgtcacaacccaggcccagggataccttctgatgaagatgacaagcagcccctgccccagccccagaataaatgaaagacagcaagattgtactttagcaaaggtggggcaagacatggaggtgatgctgctgcttcaaaatcgattgttgtgtacatcctcggggagcaaaggggagaaattctgcacttaattttccggagaaacaaagcatcacagaggattctgagcccagaccttctccttctctgctgcactgctccttctctaaggtgaacagtttcatttcctgcctgagctttctacaatgaagtccaataactcagctctctgctgtcctgacagtttagttaaacctacagaggaaaatgttacaaatacaatcccaggcaagaggggagttgcccataggctcaaattaactaccagtccccaaatagctaaccctcacttatcacacagaaagaattctgaagcaaaaccaaatccataagcaaaattcatcacgccaggaaagaggagaggggaaaataaacacctcaagtccacaactactgtttccaactctccctcctcactctgcgtcctgacagagactatgttcgcagccatccctctgcctgaagaggtaaatctgtttttaatgcaaaactccttttctctctctcttttttgtccttgagaccagcactgagctcaccgaggaagcacggcctaagggtttacacctgtgacccaaactttccattctgtgtgaggctttttttttttttttaagaaaaacaattcaagggaagtttccgaaccactgcttttccttaggccaatggttaccaacagcgacagcaaagcttttcattttcaagtgtgacccaatttatgacttacattacaccagatttcaccttcacttctttccaaggccctgcgaaggccgtcttttcttgcatactggaaagagtgaacatcaacattttaagcctctaaagataatgggtgacggttacctaacatgacaacccaaagtcatttctccctgtttcctagatcttgttctgtcacaacttatgtagaacattagaagagttaatatggacaggtgagtcctaaaaatgagtcttggacagctcataacatggcagaacaccaaggtttcaccgctttactccaaagacgccacgtaaatgtggctttgcctcttaaagcatgagccaatatgacagcaaagctgacatggtgatcatggagtgatgacagttagcttctgagaacttaagtccaacataattgaaaatcaaataaataggtagttaaataactatcagaggttttattctcatgcaaatccatcacagcagcgtaagaaatgtagggatacaatcatggtgacagtctttgttcaatctctggctagtccagattgcttgcagagatgttccctcattttaaatgtactgccatggtgtcttagtatatcacgaggggagaaaaaggcccctcacaaagatacacacacaatccaagcaggatagagcctgagatcctcactgaaaaacaaagaaaaagggaatgaactcaggttcacggctactggtaccagacatgtgcggtgtgctctgcaaccacctgccttgcccactacacccagccacactgtgaaatcaagaccgggtatctcattttcagctctcactcataggagaaagtcgggagcaggaggaggcagactaacttacatcaagtcaccttgctcctaagcacacagctaggacccaaccgcaggtgcttgtgactccaaagcacttttcatcacaccttgattccaaagacggtgctcgagttatttagagatgcagccctttgctaaaagagtctgccactgcactgccaaagcttctttcatgataccaaagttccactgtggatttagagacaatagacggctcataagtcgtgttaagccatgatgtgtcaaaggtgcaggtattaaatgctgagtcattgctatgctttgcagagataatacttcatcctccctgcccagtcagctaggcttggagaaagatagctcaagcagagccgggcaccagagcggaaatgctgggaaaggtttctctctcccagactcccttctccactcccacacctcagcaagtctcagtgtctgcctgttttaatgattcatgcacaggagaacaaggctgatgtcacggggccaaatctgggtgaatggaatgctacccttcccagctgtgcggcatgaggaatgttctcgcgagatcgacttagagaaatttgctttgagacacttgcctttctcactttctgtcacagttaatgaagtcagatctcctgtttgtacaccactcactcggtgtctacaagaggagataaggcaagctcacaaatccctagtctgtaagttagtgtggtgagtctggtaggtgagatgcacaaaggcttgagcgtttggggtgggccatcaggaaagggctccagaagcattggcatttgactccaatgttgtgggaagtgtgatagctggagctggggcaaatggaaggcgctatactaggctaagagaaataccgaagaagagataacaatcctaaattaattgggaagagcgttaggtttgtcttaagtatttcttttattcttccacagctcagatttcaagcctatcttcattgatggagccttagtctcaataataaggaaaaccaatctttagaagattactaagaggttacacagtaatttacatttaaataggtaattactgaacaaaatcgaaataaaaatctaaaggaatgattgtaatggtggaattttagacaacatgccaagtggaggggccatctcagcatctatcaaatctcatcacttagggcagtactttcaaagtgaatacctagacctttagcagtgtgaggagaactacaggtgatatgtggatatggcattaacaaacaatgaatgatgtaatgagaaaagtaactctatgaatcttctctcaagcagtcaagaaaaaaaaagtctcactatagtgctaataggtctttaacacctctctagcactggctaatctctcctttcaatagagagaaagagcaggcttctggatctgaggcttgttggcttatgacaataatatgtacattcatagcaaagggacatttggaaaaaggctataaagtttccatgaaaaaaattaggtaaaaaaaatagtgtctatttgaaagaaaaatattaagcaaattctgacataggtgatatgcgcacatggcaaaagttgtgaaggtggcacgtggataaccaaagtgtgagaaatccggtctcacagcctgttcatcaggcagctttacctttgggctttattgacctagaagtaaaatataagagtcagagtcagcaggaaaagccagctctgagtgctaatggcagcggacccagaggcagggcatggaaatgttaccacgctgtctttcccaggcagaagcaggaaagagaccagtgacccactgtccaaggtcctttcctttgcacagcaaatcaaaaatcatcagaaagaggtaacaaacataggctacatacatgtggacatcaaaatcaggcttagggtttttcatgggaaattcataatcatattatagctataagaatgaaacatttacagccaaactttcaattatgacatagcattttgttctattttcatgatcacacttcgtttaatgctcaatatcactgacatcttggtagaacggatagcatacaagccatataccattctttttaaaagcagagttatgcaaaatgtgctttaaaacatgttgtgaagaaatgcaaaatcacagtttttaaaatgggaagaaatcttgactgccctttgttttgtcagaaggaaagtttatcacccaataaaaaagaaattatacttgtagctttaaataggcaagaatcacattgtcaaaatgcacatattttcttggaaatagtcacccttaggcaggaaaaacaaaattgcttttaatgacagaaatttttagattgtgcttggaagggaagggtgtttataagaaataaagctaatgagtcagagagcaaaataaaatgaatggtgcagttcctcacttgacagtgcataacttgataagaaatcaagctctgctagcagcaatcattgaaacgtccattctgaactgaatggtgccaggtgactgtccttagaaggaggcactcctagcctggaggtgcttttgaaatcttccaggactaaagaatcacacccttagaaattaaggaatgtgttcctgggtgtgcaagagttaaaacctcaccaatgttggcactctaccagctttcacagttcttttggttgaaagcttacattaaaactcatgaaattaaactcattaattaattctttgtgttttcttaacaaggacccatcagctacatgtgatgtagaaataaacaattgaaaaggaaaaaaaaaataggccatacaggttatttggcatcatgtaagcattaaggaaatacagctgcttcactaaatgacattttttaaaaagaacaagtctgaaatgttgttgtcaaaccagtttatgtgttgataggagcacagaatttaattacttatgggtgatggaggagaatatagattctagcacacctggtaaaatttaaaccacattctgccacaaccaccaatgaatgtttagcaggaccaactaagtgcttagcattttgaatttgcaggatccagtgcaaaataaaaatgtggggccccttgttaaaacattattaagaatttcaagatggtagcagcacaacattcaaccaaacaccaggcccttttgaacactgggtcccatgtgactaccccagcccagcatccatgaagctgttccctgcgctcctcaactgcagttacactttcaggcccctaagaaagtaccaaaccagtggtacagacttgcccatcctacattcataagaaaatagatcctcaaatgccctaaacaatattccccttaatagattcaaagattgatctaattttggtatttcctctttcttttatttttttttgcaagcctgaataaagacttctcaaaatatttcagtttcctgctgcggagctaagccaaggaatggcttggttgttaacaacaggcagttcagtatattgtaaaggaagaagttaacaatcatctgaaagtcaaggcctgtagcccaccaccttctgactgaccttgccacagtggtgtctttcttttcttgttaatgtgtctttcaacactcaaacaggatgtcaactatgagagaagttactgccccccctttattttttttttttaccacgcacccaagagctgtttccacatcacaagaatccctgttactttccagtgaatgactgtgcattgtggcttaatctcaaaaggaagtagacgtataataccttaaaagaaaacaaacatgcacacacaaataccagaaagagaagtcatcccacaaattccacctctgaattctagcatcatttcttgtttctccatttggaagcttcaaattattctctttaacaactctttctagcaatgaaatatgaagaggtgatgatttcctccaaattaggaggacattaacaattaagtgttaatgcgaacaccgttaacagtaatgcaattataactgtattccacaaagggcaataggaaataattactctgattctcaagtgatagatagttccaggagaatgagattctcagtctaaaattcattaggaggggctctgaaactcacatacacacctacagctggagagccgctcctttgctgtaataaccctgtaagtgccaaatctggcattctcttgccatctgcttttagtcccaaaaaatggcaacagtgagggtcctgggaacactaacttgctgcttctggggctaccatacagcactcagatcctgatagggcttatctgaatagccagagatgctattttaagcctccaagctggacccaaagcaaatgacacccaattgttattatacggcttctgaggatgatgaagtatatccaaggaaatgactaatctccaattatcatatgcatggcagcattgagacttgaccagagagaatggtataatagcagtgaaaccattaatgtctgtgtcagtcttatttgattaaaattggaggactaaacagagaagctgatagaatcagtcagttgctgaagttttctcctaatgatgcatagatgggaattttaaaatgtgcctctaaattctatatcaattctcaatttcggcactccttcaacaattcataaattcttctcccctttaatattttaaagattaacattgctgataatggataaactaaactttttgaaatttcacttctctattctgtactttgtggtggacatgtccacaagaatgatgaaatgaaatcaggacaaggcggaggcaggagaatcacttgagcccaggagttcgagaccagcctaggcaaaatagcaagaccttatctctaaaaaaaattaaaaataaaaatacacgaaatcaggagtaagatgtcttttttatctcttttcttcaagaaaaacccatctactaagttctgatgatttctttcttgatatccttctcagatctctcagaacccattttaataccgcaggctcatgcaatactattgtcactcatgcaattagtataattaccttctagctggtctcacttgtctccttatcgcctcccaattcatcaggctttcccaggttaggaaccccagtgactccctattctgtaaaatcaattctaatttgtgcttggtccttcgcactccccatattttggtagcatggaacctatccagcctcaattcccaggactcttctgtaacctggtcttctcacctgctgtgcaaactcctaccttcaggcctctgttgattccccctttttgcctccaattccctcactcctccactgggctttcttcagtggttaagttctgttaagctttcattaccttcatagcccaccaagatctcttccctttctgagactgcacaggactgaggatattattacacttaatgtgtgcagttacagagattattttttctaaatctgagacatggtcccagtaacattttatattccttggcattgataaggatcatgtcactatcttgtctttatccttcattttggggcacatggtctacaaattcatgctagtcagttgatgatagaaacattaatcctccaactgaataatgtagcctggataaccgataatgaactacttctactaataggtgaatccacttgtaaattatgggtagggcaaggccatgttgcttagtgatggctggaccatggattgtgattatttacaacagctgaaaagatgtatttggtgatccatccacatgtgaatggtaactaatgaaaaaagaatttaaacatcaaagaatacagtattctccttcatagcttggtgttgtagctataggggataataaagacagtgatattacatatgtagtagttcttacatgtagttgaagatttatctattgtttcttttaacatttaataagttatatccatgtccatacgttttagaaataactgctatattgtttcaaagagtgcaaatagccttaagtctgcagtgatatacacaagttctgaaaagctatagatattcacagaaaacacatgcacaaagccatacacacaaaatataaagtttgattgaataatttattattccagaaaaacaagagtaaatgtggatattaaaggaaataaagacaaatccattctctacaatgcttgggggctaatttaacctacagtaattagacatctagcagatctcacaactagtcaaaccagtacttccaaacacttgttttattacatgttttgtcactaggttacgatggcgtcatcaaatatttttatcgtaagcgtctatacttgcagtgactcaagaccgtgtttctctcagctactgcaaataataatgttaatagtattagtgatgataaaaattgtaacactttggatgttaaaaacactagaagttgttagtaaaggtctctggagatttctactcagaatttaaatgagaacttgagataattcttacactcctggctgcaaattagcaaccatcactccacagctttcatattaaaactatgggtacttgaagactttagtcattaataaactttgcccaaaggacattagcaaaaggcatgcttcaggtgatgggatagtgcctcccaggacagtgggacttgtcagactgtgcaacaggatcccatggacctgtctcaatcaagttaattagagacatctgcagcacagagatcaagccaagccagctctggcagcttatttgcaccaaaaaggtacaactcatgtgggaggtaagagagctagaatgacaaacagatagagatcagtaacgtgagctggctcagtcatctgagtgtactcactgttgaaataaagctggtaggaccaagggatgcaaatgtcgagctgatgaaaaggctgaaggatatttgaacaaacctttgatattcttagcccctgcaggcatctcaacactgtaaatggagcccccagtctccctccccccagcacctgcttgaactcttcattcacctataccttacctcctggggttgctctcactcattccagggaccccagccaccgtttttctgcaaacaactctgccctcttccaagatgttgttactgatggagatctgatgttggaagttgtagcctttgtactgctgacattggttgaaactttgcctctgaaacttacactctattcgacccaaatcttgactctaaaaagccacatcattccccattgcttccaggtctgattttttttttttttttttcagtctgagtctactcatcttagtggagtttgggtctttaaatatttcttttattcattctccttgttgatatcattcttgaattccctaaacatgatagcagccagcttctaatgaattccacttattctacttttcatatacacaccaagaagagccaggtgtctgctcactggggaggcaaatagaactatgcccaaagtcagaatgtgactacaacagatttaattctcaaagcagaaggaatctgaaaatacaggtagcctaacactctacaatttggtgtggaacagatgccaaaccatgacacattcttccagctctagaacgtgttatgatccgatattctaattcattaacaatcggattttcacttgaatttttttttttttttttgagacagagtttcgctcttgttgcccaagctggagtgcaaatggtgtgatctcggctcactgcaacctctgcctcccgggttcaagtgattctcctgcctcagccttctgaatagctgggattacaggcatgtgccaccacgcccagcgaatttttgcatttttagtagagatggggttccaccatgttatcaaggatggtcttgatctcctgacctcgtgatccgcctttctcggcctcccaaagtgctgggattacaggcatgagccaccatgcctggcctcatttgactttaacatccacatagcaaatacatgactatcatgcttttgacacagatctccataaaagacagattgtaaactgatggcctgtgaatcaatttcggccctgtacacttgagtttagccagtacaatgtttcagagtcatctgaaccaatatttagaaacccagagatttcaaataaagtacatgtttctaccttctcttgaaaacttggatgatcagatgccactggctccacattcttcttacacagaaatattctgctggagtggatgacacccagtttgtacaccaggtctgattttctcacttaggtacctgccggctgcattagccatgaaagtttgcatcccttgccaaagcacccacgcctttgtcacttttcagtataccaagtaatcaataatattttacagattgttttccattttaagaaatggtcatcagcactgaacagccacaatggagttttcaaggatttcaaacagtctgagttcaaatctagtatgtaaaaatttcccagaggatcagaaacccttgttgagttttcctccaggcatgactaatacaatacagggaggtgctgtcatgcaaccatgcatctttgcattacgaacgaggaatggtttaattgcaattcacccacctatagcatcctgggatggctttatcctgttgaagggcgtatctttaggccactaactttgttaaaatatgtcaggcctgttggtatcaaatattggctaacacaggaaacaccacctcaatcttgttaaatatttttagcaagaggccaccatgttccagaatgatgctggctgacctgccagaggcaagaagaagccccgaagatctaagacaacataaatgaatgactaattaagggccattctaagggaaaggacaattatgttgactcataactgtctaggttcctaccattcaaggcctatacaatttacataaaaatcattgtcattagaaaagtttctgtcccactgttaagacagtgtttgtgcaatgtgaggttacttcctgcttccacaatatgactgtgctttactaaacaaacttctgagctaagatgtttacttgactgggaaatgactactaataagctgttaaaggatgtatcctcaagttactacttgtggcatttgtaacacgctccctgttgaacaaaggtgtcacagtagcacagtgaataaacaatccttttttctccctgtaagttatacgatattaaatgttaataattaatttgtctttgtggattaacatacaagagcttttcaaacaggtactggtgcaaccccacccttgtgagatggctaatcatttcacatacttcacacttacccagctatcagtatcactgacctcagctagcaaagtgtgaaacggcagatggtttgtagtgttcagtaatgtcctatgaaaatgtagcacagaaaactgcaaaaggttttgggagagaatggtggtttatatgaacttttcaagaaactcaagagaaacaaaatgccaccactgtccacgtcaaaggatctggtgaggatcctgggagaaaaatgtcaagagattctaaggctttcagtagcacaatattttcaaagtgcttcagaagttatttcaatctgctgcattgctaaaggggaacagagcctgaaaagccagtataattttgaaggctgttcaaggactatgtcagcaacattcttaccctgcataagacttatacatcttaagacagaagatttgtctagggtatccacaatctgattacatatttctcacgagaactaccccaaagtgcaagccctttgtgttgttctacctgagatgacatgacttcagcctcaaaatacccaggctgaactgtttctggagcaatgagatgttgttaatgaatatcaacacttcccagatcctttaaaaatgctaatatcaaaatattttacaagagtgaatttcaaactgtgttcatgtttttcacagcacggcacctgtttgaaatggtacagtttgaacatctataaaacatgagatggaagataccaaggtggcttgagagtttttaaactatatatatattttttttttttgagacagagtcttgctcttgttgctcaggctggagtgtaatggcgcgatctcggctcactgcaacctccgcctcccaagttcaagcaattctcctgcctcagcctcccgagtagctggggttacaggcacctgccaccacgcccagctaattttttgtgtttttagtagagattcggtttcacaatgttggccaggctggtcttgaactcctgacctcaggtgatccacccacctcagcctcccaaagtgctgggattacaggagtgagccactgtgcccagtcaagaactatattcttgagagcaaaatagagtatattatacttagaatggaactatgtaaacctttacacatctgtattttcaaaacaagaacccagagctgttcaagtgataaacaaaatcatcaggtggcttgtttagagtttcaaaacagacccttctattcctgctgtttctccctctggtttcattaaatataaaacaaatgaaaatgaccagttcaatagggatatctgacagaatttggggagaaacatttcattagctttctatgaagtccaatacctgtaattttatgtatcaggactctctgatttgaagtccctacagaaatgctttattcttagtccatttagctgcccttaaaatgtttattttttctctttctctctctctctctctctctctctcacaggaacatccaaactgtgttgtcacagtgtataaaacagaggcatattcctttcaggttatactataccctgactccttgatgaaatgatttgatgtggttcacaaatcagaatcagacagaatgaaatcattacaccttatatagcttaaaaacaaaaaagccagacataaagtggacaggaaatcagtcataatgaaaaactatttcaagtcacacatttgctgatttagtgtctatttgctgagcatttgtatcactatgtgctaggtgctgctgggtctgtgacaatgaacaggaaaggctgtgtggcaactcaacacgaaagccagctgagcctcctagtaaccaaaacaaaaagagaaacatcacacagtttcaaaagggaggttactggcttatcaagagagaaaaaaaatgtcttggtaagaagctacggagaaacataaggaataggtcaatgtgtagataagagatactaatcataatattaacatatagatatttatgtacctatgtaagactttctcttccactaaaacagatgaagtaatttataatcttttgaattaagcaatcaatagaataatatctgcagaaactcttatctttctggactgtttaaaggtacaaatctagaaccaaagtcgcatatgtgatttaaaacaagcagaaaatacatattggcaaagggctttcttacatgaggtattactgctctagaaaattgtctacattaatttataactgtaaaaggatctctggcaattacatttatcctattctcttatttttcaggtgtcttttggggatacatgttataaatcttttttatttctctatataacccttctttcttttgggtaacctgatagtaataactaagccacaggtgaaaggtttctcaaggtgtggctattgtgttctcttgactaacttctacctgcactgtttcctttttacagggtggctcttatgtgactaatctaggccacaatatattattttttttaagttaggtaaaagtaaatgtctccagacctttaactatatagtactttatttgctaaattatgcaaatcaatataccctaaatcaaatacatacctcctctaaagagagttccccttggttttgaaactcactttaacaagctatcaatcagaggctgatatttagaggtagcataactgattggtagcagtgggatttctggccatttttagtgataaccaccgaaatacatgagcagggtttttaaaccctaggaaggaaaaagcctgaccaaaaaccctgacagatatataatgccatgatagaaatgctactcattatgtcatacctaataatccacatgtacctcattactcagctgtttgtgttacaccctgttgccaaaggaagctccctgcttctcctcctgatccagcaattaatatgcatatcaggcacagtggccagacttctacggagaaagaggaggcaggcaagagatccatagtcataaagacctaggcgagtaatattctcagcattattcaggaatgtttagttgcttgctcaaatttatcattaacaaagggcctatttcccaaaggcttccactgtgtaattagcaacaacaaatactgcccctactccggttaacctatgggattagttacaaaggttttgtaaatttcagaagatatctacacagatgtcgggagagcacacacgcaaacacacagtgcagcataatggatgcagccatagccattaagtagtttaggatttgtgagactcagacaacgaatacattttatgggggaagtcataaaagtcagacaggaaaaaatatacagcatgaaagttgaaaacttctagacagcatgtaaaaagtacggagaagtagcaggggcaaaggaagaaacgtaccaagtggagctcattggtcttaataaataggacaaggtcacctgagtttacttctggaaccaatagaaatcctgtagtatctaattatttttgtaaaatgattattttcatgcttctatttaccattgtcattagataggttcatatttcattagtctgcttactaaaatgaaacttttcgttttatttatggaagtttttatacttctctaagcctgctccaaaaacatacaattaagcactgctaacctgttgatcaggaaagtatactataccaaaagagatgcaaagacatgttaaccattcatactgattgaaagggctcaatttaagaaagtaattttaatttagattaaaaaataatctgtaaatgacagagtctggaatgacattatgaataaaaattaaggctaatgaccttatcttaaccataaattactttagtttgtagagatttgttcacacttggtaagcagcactgttcatttcttatgatgggtattcgtgtttaaacaagttggcaattttcaattcagaagtcaaaatactgtcttagttgccaacaaaaataattaatgaaacacttctaaccccaggggtaaatatgtaagcaagtgcatggtaatggataataaaaatagcacttccttttacatatggtgctaattaaaatctgatcagagtaataattgagcagtgcccaggctacccttgatttttcttgtcaggtttcaattgtttgacacaaatgcactgacctcaataaatgaaaacacatttaaaaaaaaaaaacaacctaaattatagctatccttattcaggccaacaagtgatttactgtcgctgtgggttttgaggttactcgagacatggaagttttctagggagccactcattgccactggtgttcatgaacaagaaggcaccagaaagtccatgagactttcattcagaggtttttccccactgaatacacaactccctccctatgcaaattccaattaaaacaaaagaataatatattacctaaccaggggttgaatgagtgtgtgacaggcattttgctaagagctttccaggtattatctcaagtcttcacaacatcctgatgaaaaagaatcattactggtcccatcacactgacaaactgagtctcagactctggctccagagctcatggtcttaatttgctacactatcttaaagtaatggaaaaaatgcacaccagtatattttaaaaaactaaaaaaggaaagaagattctgagtacaatactcgtactctccgaaattaccctttttcaaaaagaaagattaaataccaaaactcaattgaaatcatactgatttaattctacaatgtgatgtctaaaacctctaagtacctgcttatataagtaaaaacaagtcatgagaaaataagaataatacatatttccatgtcccaagtgccccaccaatatgcttcatattcacaaagctctagttaaaatgggaaaagccaacagattactattttaatatgaatgcttaatgaaatatatactaatactcacattcaatttttccataaatcaatgtattgctaaaacagtatacacttttatccactcaatagtcattacttttatttaaaattaaattcaactgtattttgtatctacctacaacttcttgccctgtgaaggggtacaaagatgtatcaaagatgctctctgcttctaagaaattgtttattaactggcacaagaaatagcatcaactataatatctggtagagtgtaaaaaagggtagagttcaagttcctaaaaatgttaatgcgccaggctatacgtaaagcgctggcctaggcactatatggatcaagactaaagacacaggcactgtcctcaggagcattctagtggagaggggaggtatccaatacaccaattacgtgaatacctggcttcctttcttaagtgtataaaaagcaaataaagccttaaagactgcttcacagagctctccatgagcagggctggggatacacagaagccagggaaaacagatacaagactcttgcagtcagcggtcccagaaagacaaaatgagggcttgtccaaaggccttgtactgggagtgaaggcaagtggaaggaacgagcaatggggacaaacaggtctcaaagggtgggtgactgcctagaaatgagcagaaggagaacttggaaataacaggtctgaacaaagagacagctttatatgacagaataaataagaagtatgttaggtagacaagagaaatagatgtggtcactgacttgtggagcctgaggagctggcaggggacattcagcataaatttactgagctcctattacatagcaggcactgttctaggatccagaggtacaagagtgaacaaaacaaactaagaggtgtgcagcaagcaacagggtaaagttagactctcctgctgacaggcaaaagccagaaatacagactgagaagtgtcaactgcaaatgagaaaaaccctcggttctcctgtattcaggagagtttcaagaagagagaagagaggctacaacactgaatacaggagtgagttggggaaacaatctggctggatgagaactgaacttaaccgatttgacatttctgtgactgttgagatggccttctccatcgcactgggccaggatccagcaggaggagatcacagcaagtgtgcctttgagaagtttgttattaaaatgaaataaaggatggtattttgatacatagttctctgagaatacagagaaagtagtgattcattctgaccaggagatctgggaatgctgatggttggcagtgaggatgtcctctgtttttgaacaataaatgcaggaaaagaaactgaaaagaatgccaggtatggtggctcatgcctgtaatcccagcactttcggaggccaaggtgggtggatcacaaggtcagagttagagaccagcctggccaacatggtgaaaccgtgtctctgctaaagataacacaaattagttgggtgtggtggcacacacctgtaatccctgctactcaggatgctgaagtaggagaatcacttgaacccgggaggcagaggttgcagtgagctgagatcaccccattgcactgcagcctgggtggtagagcgagactccatctcaaaaaaaaaaaaaagaaaagaaatggaaaagggatgatagagagtcagggttacaataaggtctcattacaatacagctttaaacattagaaaacaaacactgtcttgtgtaatcatacacttctaagttagacatatttctgaacaagataaaatgtgctacataaaaataaatgctggctgggcgtagtggctcatgcctataatcccagcactttgggatgctgaggcaggtggatcacttgaggtcaggagtttaagaccagcctgggcaacatagggaaacccttactaaaaatacaaaaaattagccaggtgtggtagcatgcgcctgtggtcccagttattggagaggttgaggtgggaaaatcacttaagcctgggagacagaggttgcagtgagccgaggtcgtgccactgtactccagcctgggtgacaaaatgagttgatcttgtctcaaaaaaaaaaaaaatgctatttttgtttaaattaggcaaatatacttatctgttatttaagactaaaaacctgatttcttggtcctccatctagaaaatagtctgttttaagacaaggaaatagttcttgtttaaactagagaatgagaagtctgtcagacacatggccccactcttgctccaagtccttctcacctattctcagataagacccagatcttgggaaacaaattaagggcgcatctgctggattggacctagctgcactgggagttgccagagtgctctgagcagcatcaggaattcctctgggccttgtcgtgatatcatttgcgcaatgtagcctgtgatggcagaaaattaagctggtatttatacagggtattagagaaggaccctccctgcaccaggcttaaagtgacaaaatgtcagcctcaatcatcccacaggctttggtctccctctgtaacctctttctttttggctgctctctctctctctctctgtctctctctctgtctctgtctctctctctctctctctctctctctctctctctctctatatatatatatatatatatatacatacatatatacacatacacacacacacacatacatatgacactaacagaaaaataaattgaaaagagcactgaggcagagtgtatttcacgcactggtgccaatgtttcatatctcatgaacctcgggaaaacaattcgtagaactaattagtttacagtgtttaagcagcttgttcctcgtctttaatcttctttatgtaatagtgtgaacaaagccatattatcttctgatttttttatacagtttaacaaatataatctcccttttctttccagagattacttcatttagacatcaaactatgttgttgttgtttttttcccctggggagaggggatataaataaattgacatctattcacataggtctcaatggtctaccagatccacccaggccctaatcctctttgttgtcatggaatccacctggcttaattatatttacagttttcaacgacaccacatggcatgcaggttttccctgaactctgcacatcttcccgaatcctagctataagtcacactccagctgctgtatccgtctcggattctagacggtgacaaggcactcttgcctgaaactcagcatcaggtcctcaaagaatagagcctggataaatctcccctccagtatttttatagcctactaaaagaacatgatttaagagaactcctgacctaaagccaggggatgggaaatagatacatatgtgtacaaattagttgggtggtcaggggagcaaagaagaacaagatacttaacttacaaaagttttatcttaaaatactgctcacaagtatgacttttaagagaaattgaactttttgtgctttctgattctagataaatatttagttgctaagctgctggaatgctatgagatacattttgggtagagtcaaactgaaatccaagaactgggtaaggctagtgttgaagtaattattattcatctggtgggtgatgctgcacacaaataactacttgcactgctaaggatttggagcagagttactccctgagagagacacttttcaggtggcagaaacctacctcagacttttatttatacactggaatccacattattaaagaattttacagtcttggaaaaacacaggacttggtgcaaactttcattttgcttgcctgagaactgtgtactgtcccatggtacccatctgccttaaagttcactctgtccttaattgtcaaacagattcatggtaactcctaattagtgcaaaacaggtaacacagctgcgactctgcaactgctgaacacctttagcatctatatcaagctaagctcaggagccctctctgctctctcccaaggttaatggtttcgagtcttctgagaattatggagtaggtgcccacagtgagagagggcgcctggttctccaagccgctgttcccactactaatagagtcagcataagaagcagccagtttccagcaacggtaacaatggagaaatttctcttactgcacagctgccaaataactttgaggatctgattcagaactaacatggaagatttaaatggatccattgcaacagacgttttgcatgttggcacactggaattagaggaactaatcagagccagagtggtaccagatggtctcttgagaattcttctgagtttaagatatgtgagccaatgagacaaactgtataattgcccaagattttactctaagagcactggcactgggagtaagaccactaggaaactcagctctgccactttccagctgtaggacttcaggcaaattaattaaataggatggtggtgaagaattaagtgagatactgtatctaacactcagggtacctaggtagagcacagggaagatgaggagctgttaactgtgatagttatgattttgtattttttttttttagatttctgagttgaggaatatttgcaagcaggtacagtaattacccaattcagatgtttatagaaaaagaaacacatcttaaaaataaaggtaccacaaaaaacaagaagtagaaaattggaagatggagagatgaaagaaaaatgaagaaatttcagagaaaaatgaaaaaacaaagcagattttaaaaagaaaaagaaaaaaaggtaggaaatacaaattaagaaatttcagagaaaaatgaaaaaacaaagcagatttttttaaaaaaagaaaaaaggtaggaaatacaaatctaagaggagggtttgaattcctaatcctgttctttttccttgcacttctattcaaatcccttttctgcatctcaacttttgtctgcactagatggtccaattctagccagacttcaacttgtagcagtcccaaggtagaaatgactagaaaaaagaaagttccctcttagctatgaagaatgaaaaacattaaaatgcaaattcaatgtaaaaaagaaagcaagactatacacacatttcacagtagcaaattctcaggcagaagtggaagccagcaagtaaccccctgaggtgtgctagtgtaactgtttcaagttttggggatgacagataaacagcaagtcctattactactgaatgaatctctctctctctctctttttttctctgggaagaaaatgtttgtgatagaattggtccttgagaaagagtgaattgatctgttagctttctgtgctggaccagaaataattattgccatacctacttcctatggattatgttcaaaagttagagatactcacttattctgtctttatgctatggggaactaatcggaactggggtttgcttcactgactctcacttattttaaaagtcaggcttagtaggaaagaaaaagtcaaagagattgaccaagaaaggatgaaatgttcggtctaggtaaacaaacactgtctcagataaagttctccacgggtctcgacctcaccttctactgcgtatgaattcattttacaatgttcgttttttttaagctagatctttgtgtgcttattttcaacaggggatgacaattgatttgttttctattgaacctcgccaactggatactgaagcgagcacggcatatttagatgcccttaaactttcaggttcacctttaaaacgtgccaagacaatgtcatgttgagggtaaatgtgcaattttcactaggctgagacgagaaatgagtgtctcgcaggtgaaatgacattaaaggcgttacagtaaaacagagaccaatccttattgattcattttaactcaaataaaattccaataatttgatggacatgaaatagcaaacaaaggaaaaaacaaatcagatgattcctgagtgtgtgtgaaagagcacccaggccctgctagaaaaaagccacactgccaaattcaaccctatgtatattcacaggcacttatttagcctaccggcttctccttcaggagtaggactggtaaggaactttaaaagctaaaagatatggaagatacaacctaatcaggttcaggtagctagagaaacaagacacacccataagaaagaacttatgatgataattctaaaaaaaaatgcataactacatagtggagagtggttcgggtaacttatggaaatcctgaggctataaaagataaaagaaagacatcagtttatagagttcacccatatctaactttcttctccttctgggcgtatgagagtattatacctctctactaccttagagttaggcagagttgtgggcggaaggaacatgagtcacttttgggctgaagcaagactcttcagtgttctcttatgtggtggtttgtgttgagatgacaaaaccacaagactgaagaggcctctatcattgagtcacacacagataatagttacctgccttaataaactctgtcaaacccctgagatcctggggctgtttgttactgcagcacaatatattctgtcctgacaaatatagataccaaggcagggaggagctagagaaagttactatgaaaagaattttagggtctcctcagtgtatttatactttagtttccttccccctttggctgacctgtctgcctccaatatctctcaaatactccacattgctgctagagcattctaagacctacatctgttcacatctctgtttgaacttcaaatggaatcgcctggcacaaaagataaagaacaacttccttagcatagggtcaaggcccatggtatctggctctgtttcccaatgttatttttgcccactagttcccatcctgtattcctgccgtcagcactctgattgagccacattctgctctgcctccatgaactgggacacactgctgtgcctgtaatggcccccactccctcttccccccgggtgaacacctaaccaacttctggcaggattcacttcctctgtgaggccttcagctcctctctcctccctcagcactttgtgcattctgttacaaaacactgttccttaaaaactttgtttaatccccttccaatggatagtgagttgctcaaggcagtgagtgattcacttttgtttcccccagagcatctagcacagtatctgacaagcagttagtatttgcagaaataatgaatgaataaaggaaagaaggaatatctgcatggctgtgtccatgagagtattaggcagatgacaggggcagagtagaggtttgttggatagaagtaaaatgtaaatgtaagcagccagcaggtgtcaaattacaaagaatgagaatttttcacttgatccaaaaggtaatagggaatcatgataacttcatgagcagcaaaatgataattttgttcagccctgtagcaccttgtgccttgaatgtcagctatgtttatgccaatcttattcccccttggactgtaaagctccttgaaaacagggtttgtgtcctaatcatatttgtatcccctatagcaacaagcacagtgtttgtataacaggtgccaacaaatatttgctgaatttaattttacaaagattactccctatgcgatgaggctggatagaccagctagcagactactgtattatatccaacattacatgggaaatggacttaaaggggagtattgcctatggaaatgtgaaaatagaaatctaagatggtctaatattccagtcagcagcctttagggtctctaatatcaattaatgttttgagcctggggtcccagaaaaatggtggtctatttaaaacacaaatgttgagaggaagatttgcttttctcagggagtacatgagtcccatgtgggagataacaaaagaaaatatactagagctaaaagcagctagaaatactaaccgctgtatacaaatgttatcttatcccccatcttgcggcttagttcaatttttttattgattgattgattcattcactcactcattggttttatttttgtaaatttcttacattgtataaagtaatgtttctgaagtttattcaagtctatttagattattgtctgtttcacattaatccccaaagtcaaagacggtgagtgaagtaaagaaatgatgtgctagactcttctgctttgggtttcccagatatctctagttattctctatcagaaagggtttgcaggggcttcctcttgttgaagtaccctttttaaaactccagctgtcagcagggaatcctacaagcatcaaattattttacaaatcccaagtttaaaagagcactccattcagaagctatacctggttttattatgactcacttcttaagaagacacacacacacaactagtgagcccttaaaagaaacattaagaccgaaaaacaaaaaaactctttttttttccaagacagcgtcttgctctgtcgcccaggctacagtgcaatggcacgatctcaaatcactgcaacctctgcctcctgggttgaagcgagtctcccgcctcagcctcccaagtagctgggattacaggcgagtgccacgacgcctggctaattttttgtattttttagtagagatgggttttcacctgttgggcaggctggtcttgaactcctgacctcacgatccgcctgccttcacctcccaaagtgctaggattacaggcatgagccactgcgcccggccacaaaaaaacctcttttaagatactgtccaaagcctgtacctgagggattcagtgttatacctcccaaaataaaatatggatttaaaattcaaggtatatataataggttatcaataagttaactattaccatcattacaatatttcatttaatctattgcaaactcatgtattggaccagacaaaatttgtttgtttatttagatggagtcttgctctgtcacccaggctggaatgcagtagggcaatcttggctcactgcaaccgccgccttccaggttcaagcatttctcctgccccagcctctctagtagctgggattacaggcacgtgccaccatgtctggctaattattgtatttttagtagagacagggttttaccaagaccaggctggtctcaaaatcctgacctcaggtgatctgcctgccctggcctcccaaagtgctgggattacaggcatgaaccaccgtgcccgtcctggaccagataaaatttaaaccaaacttaacagattaaaattttctgtgggttaatgttaaaatcatacctaaaaaagttttagtccaatgtgaacctaagttcacattctaaaaggtacctggaacctcaggtgccttcactggaccctaaagcttccaagcattttgtgattgatttgaccccacctaccccccccaccaagatctaacactaatgtttcattcctgcaactgaacattatcagtttttcatatcatttatttgtggcaaaatgagaaaacatatccatagcaaggactatgtacaggaaagttctctgagtggccttgcactgactcagttatgctctttcttgcttgtagctctcaagaataactgtaccagtgtgctaggaatgcaacatcctgagataagaggggacctggctgaaacagctggacttagttccaatgtccccagaacaggatgtccttcaacactttagcccagaagatctcatgactcagggtataaaacccagggtgggtggatctccagggtccctcagctggggtacaagtggggcatgcagggacaagattccatctttccttggcagcttgcttgaaccatgggggaccagctagctagcaattaattctaggattatgttattccttgatgcctatctatagataataaacccgctttgtataacttgtgtgcttgggtgttctgtctcactagactcagagaagttggtaaccagtgcatagtgaacttgcttcacactatgtcatttatttgtttatttatttatgtattttagtgacctgatcttcctatggtgcccaggttagactccaactccctagctcatgggatcctcctgcctccacctcccaagtagctgagactacaggtgcacgttaccatgcccagctattgcttttaacacatcccacccatgctttcagttaaacaattattctatctccctgaattgcgtgacattttccaaaaaaagaatcatcaaatgaatcctttcaaaagaaatcaagcatctcttgcatcctcaccctgcagcattaagatgcaggcctgccagcgagggggtgaaatcttcaccctcacctttcagggaagtgcagggtaggctaccacctgcactgcaaagtttatccaacatgagagttcctttggcagggaacattaaccgctgacttatgcttgtcactgcataggtaaaggacactgatacaggtaaagaagtctgcatgtgcactgtcatgaccaatgccttacagcggctactcagattcctctttacttactgtgtcaccatccagtggggaaaagcacctcagtattaatcctagttacacatactctaacaggacatgatcttaaccattagggcagtattaattaaggtatcttgcagagatcctgctcattatatatttaaaaacaagatgaggtttcattaactcttttactttcaatcatcttcaaactcagctcctagaaagcaaactgggttccatacttgcttaaggcttaagaacacattttacatttattctcattcaagccacattgtgatatgaagtgatttatgaattagagagcacatgtgttatcagaattccgtaataaaatgttcagagactcttggctttgtcaccattagggacaggacataggcttgcttttccatggtctggccaaacggcctccaacgacaggacaagtccccacctccaggcatattaaaaattataacatggtatatacttcaggcagcagaactcttaattctagcattttctcaaggcaatacagacggcccctccctccctccttcctcccttccttccatggagttccgctcttgttgcccaggctgaagtgcaatggcgtgatctcagctcaccacaacctctgcctcccgggttcaagtgattctcctgcctcagcatcctgagtagctgggattacaggtgtccaccaccatgcctggctactttttgtatttttagtagagacgggtttcaccatgttggccaagctggtccggaactcctaacctcaggtgatccacctgccttggcctcccaaagtgctgggattacaggcatgagccaccgcacccagactgttctttcttttttcttggtgactggaataagggaagtctgcaatttttatgactttatatgtgtatccacaaaatctatgtgcaaagattgcctcttcagaggggaactgaatagttggaaaataggagtgggaagaagacatgtttttcactgtatacccttttatagcttttaagttttgtatcaggtatatgtattatacattcaaatactaaaaattaaattaattaattttttgagacagagtctcaccctgtcgcccaggctagagtgtgcagtggtgcaatctcggctcactgcaacctccgcctccagggatcaagcgattctcatgcttcagcctcccgagtagctgggattacaggtgcgcgccactatgccaggctaatttttgtatttttattcgagacagggtttcgccatattggccaggctggtctcaaactcttggcctcaagtaatctgctcacctctgcctcccaaagtgctggaattacaggtatgagccaccacccctggcctaaaaatgtaattttaaaagtacaaataaaagcaaaacaactacaaactttcctaaaccatgtttaaaaaaaattattcagtcttataaagttacaaaaactttttaaaaatctaacctttaaaaaaaatattcaaaatacattttggaaaaaatgcttcaaagattttatatctaaaacactgcacctggacactgttaagaaacagttatatgtcatccttttattatgataactattcagctagaaagatcattacctactttgacattataaaagttagtgaatttaaaaaatagataatgtgtttttaaaggaaagcatgttatttttccctctaaggtatgcttgacaaaagttcagcatttcaagtaaatacacattatttcatttatcagttgtgatcatctcattctcttcagtatgacttaagaagcttcaggaatgtgtttattctcacctcagtcactctcacaggcaagactcccattagagaaagaagccaccagacgccaccagaaccttaacaaaattaaggataccttagggctctcaatttcactctgaaagaaaatcatccttggccgagcacggtggatcatgcctgtaatcccagcaccttcggaggccgaggcgggcggatcatctgaggtcaggagtttgagaccagcttggccaacatggtgaaacctcgtctctactaaaaatacaaaaattagcagagtgtggtggcgggcacctgtaatcccaactattcaggaggctgaggtaggaggatcgcttgaaccgggaggcggaggttgcagtgagcagagatcacgccactgcactccagcctggggacagagactccatctcaaaaaaaaaaaaaaatacatctttaagatctattcttgtaagattttttttcaacaggaaagctaaaaaaatgcttaaaaatatatacattattttagatttgaagccaccacctagagaaaaggagatatatcctatttgttacataatgtctctccagaataattacttttatttgttcactttctagagcaaacaccatagttgttttttgttttttgttttttttttatcttttacaaccaaatattttctactaaataggagataaagaccaataaaacctttgttctctctcccttcagccaacccctaaggcatattttatctctagagttgttatctgaagtgaattactgattaaaaaaaaaagttaaaggacccagactgctgaatgtgtgcggtaactgcagtgttttccacaccttgtttctctttagctaggccctaccaatagtcactgttcctaccagcctgcttttgcagaaaagaaaaagttgcctaaataccatggctccaatgcctaaattcctttaccaagaaaaaacaaaaacaaaaacaaacaagtatattacaagactctggaaaaccgaagtcttacatttacaatgtacttattcagatttgtaaactcctaagtggcaggagaatattaacatgtacttttaaggaattttcatgggcaaacaggttaacttcagtaactacctgtacaaggtttataatgagctgtagacccttttttctaactctcttggccacaactggtatattttgccttcagagtattatcagtgtgtatgtattgaacattggcacagtctatcatttaatattcacaacaaacctataaggtttatacaattattacccacatgtcacagatgaggaaacaggcacaggcacttacccaagtgtacactgcttgttagtgttagtgtggaggctgaaacggaagcaggctggctccagagtctgcatcctaaaccctattttgcaatgagtttaatgctcttaaaatgagcagaaatgaaatgtaaaacattttttaccccaacatttttttatgatgttgagagatgacggcgtgctggcagtcctcacagccttcgctcgctctgggtgcctcctctgcctgggctcccactttggcggcacttgaggagcccttcagcccaccgctgcactgtgggagcccttttctgggctggccaagaccggagcccgctccctcagcttgcagggaggtgtggaggcggaggcgtgagctgcgggcggctgcgggcggcgcttgagggccagctggagttccgggtgggcgtgggcttggcgggccctgcactgggagcagccggccggccctgccgcccgggcagtgaggggcttagcacccaggccagcggctgcggagggtgtactgggtgccccagcagcgccagcccactggcgctgagcttgatttctcgctgggccttagctgccttcccgtggggctgggcttgggacctgcagcccgccatacctgagcctcccaccctctgctccatggcacccagtcccatcgaccacccaagggctgaggagtgcaggcacacggcacgggactggcaggcagctccatctgcagccccgttgggggatccactgggtgaagccagctgggctcctgagtctggtggggacgtggagaacctttatgtctctagctcagggactgtaaatataccaatcagcactctgtatctagctactctggtggggccttggagaacctttatgtctagctcaggaattgtaaatacaccaatcagcactctgtctctagctcaaggtttgtaaacacaccaatcagcaccctgtgtctagctcagggtgctagacaaatcaacactctgtatctagctactctggtggggccttggagaacctttgtgtctagctctgtatctagctaatctggtggggacatgaaaaacctttgtgtctagctcagggattgtaaaagcaccaatcagtgccctgtcaaaacagaccactcagctctaccaatcagcaggatgtgggtggggccacataagagaataaaagcaggctgcctgagccagcagtggcaacccgctcaggtccccttccacgctgtggaagctttgttctttcgctctttgcaataaatcttgctattgctcactctttgggtccacactgcctttatgagctataacactcaccatgaagatctgcggctccactcctgaagtcagcgggaccaggagcccaccgggaggaacgaacaactccagacgagccgccttaagagctgtaacactcacctcgaaggtctgcagcttcactcctgagctagcgagaccacgaatccaacagaaggaagaaactctgaacacatccgaacatcagaaggaacaaactccagacgcgccaccttaagagctgtaacgctcatcgcgagggtccgcggcctcattcttgaagtcagtgagaccaagaacccaccaattctggacacaatgtcatgacttaggcagtaagcatccatgaattcttaaacttttaacgttattcatttttagcaaatatctattgactccacagaatatgcagtcttgtgtaagatatttcaggggaacacgaggaagtatgacaaataacgccatgttctcaagcagtttgaaactccttggcgcctcctctccaccaaaaaaggaggaaaaaaacaaattaaacaacatttaaaaatacatttccaagcatccccggaagtcaggatcttctagtatccatggcctattatatacaatggttataggcctggtgttgaccgggttgctgggttcagtttgcctggaagtggattccagaacagcctatcaggaagaggtagtttctgtagtcaaaggcaggaggcaagctttagccacctcctgtactggcttgagataaaatcaagaaatccacctcctgactgcttgtccaggcctcttttttctgtccttcctctaacgtcaacccaatttccccaaaattacttagagcaggctggcgcggtggctcatgcctgtaatcccagcactttgggaggccaaggtgggtggatcacctgaggtcaggagttcgagaccagcttggccaacatggtgaaacccctgtctctgctaaaaaaaaaaaaaaaaaaaaaaatacataaattagctgggcgtggtggcaggcacctgtaatcccagctactcggaaaacagaatcatttgaacctgggaggcagaggttgcagtgagccaagatcataccattgtattccagcctgggcaacgagagcaaaattccatctcaaaaaaaaaaaaaaaaacaaaaaaacaaaaaacaacaactacccagcatctctttgctacagacaagatcagagagtctcgttcatcccatgtttctgagaggtaatgtcaagttattccagttcagctgcttgtgtttccatagaggatgagcatttggcctttaggagggattgagaagtaccttatcacaacgctacctacatgtttggtaggtcttacccctctcctccttcctgctctcactgacacagatttgtagcagaatatacaaagatgccttttgtgggaaaatgttgccaactctaccccagacaacagctggtgctgtctgttggggcttgctaagcaataaagtgcgcttaaacaataactgcaacttccattagtggatgacccattcctggggaggaacatcctggagaagaaacgtgggtcagcaaacctaggactaaacccagatgtagcagggcttttggcttctcctccttcagactaggccataatctccctgaatgagacaaagtagttttcagaaagtaccaagtagacagttcatgtgtttggctcctaggagcaagtcatatccatttagagtcttggctttatgctaatggggacaatgtcccctggactcctttggcatggctcaccacctgccctcctcctgacaagcattctcattgtcccaaagtaggcacctgtagtttcagaaccagctccctgaggttgcttccatttattaagacaatttgggcctagaagctggttagtaagttgccatggtatcgcgagcaaagcattagtcggctttgctttgctatctgtagtagtaggtgatcttttataaaaaattgttgatgtacatgaggacaaataaatcaacacatttacatctcctaactcatttgtaggaacaggttcatattctgctgaaaacaaaaaatcaggagaggatcagaggcagaggcctgggcagggaggctattttatgtaactgtattggtataaaattactccttttgctaaccacatctagaaggtaaacggagccttatatggagaaataatactggagaaataatagtcatgtaaagataggctgcctaagacgtaaaggctgggaaagattttttgaatagatagaaactttgaaatgtggtgagatctgattaaatgggaacctgtctggtttgcatcagctaaagttctaaagaaggcataagatgcttgtttggtgtctgcatctcacggctacctagggagcgctggaaaatcttagcaacttcttcagtttgttccacttaaatctgaggctatagaccacctctgtggggaccattacataacacgcagggcacagtgcaaaatgagaatgtaggactccttgttcaaaaagcaagaaaaaaacagtgccattaagaacactaacatctaaagctttttcctttcttccacaaactttcaatttctcatgatgttttttatttgctatttaaagtcattctgaacaaaggagagaaaaactaaaacatttaattattagcatgaagtttaccatttatctttatttttattattagtagtattattttttgagacggagtctcaatctgtcacccaggctggagtgcagtggcgcgatctcggcttactgcagcctcggcctcctgagttcaagtgattcttctgcctcagcctcccaagtagctgggattacagacatgtgccatcatgcccagctaatttttgtatttttagtagagacggggtttcaccatgttggccaggctggccttgagctcctgacctcaagtgatccgcctttctcggcctcccaaagtgctgggattacaggcgtgagccaacaagcccggcctacaatttatctttatatggtacagtgacagtttcaatgcaaatataagagcatttaacttacatgtggaataatatgacacaaccttttttcatagctcatacacgtatatttatttcattcttactagggcagtggaaacactacacaactaactcaactgaaactcactcacaaatttcttgattcatgcatattataccaacacactacaggaacagacagcttccataatccacttactttctactcccctggagcttccctggacccccacacatcatagtctatcagaattctgtatttgtgaaaaactgtgaatgtgatatgcagatagtgccacaatggacaaacaaacatatcacacatcgcctcggctcatgaagatgctccatttatgaaacactagttcaaagataaaattcagaattttgagacagtgacagcggagccttaagccaagtatggggcccttctgagctcagggccctgtgtgacagcacaggttgaatgccatgaagctagccctgcacctcagacctctggccaatatgcttagagggactattcctgaatactaataatgaggctttccaaggaggtaggtttgatgccaatgtacacactgtgataaggctgcaggggatagactacatatggtgattaccctgtaaattacctgttcatatagtttccccaggttgtgtcgttggggcctgtgcttttctttatgtatataagtatgtatgtatgtatgtatgtatgtatgtatgtatgtgtatcagccaaaggagtctttgatttcttttactgtgagatttccattggaaacagacacctgctttgctctcttctcctttttcattatcataaccaaatagcaagcacatagattttggttagtcattctaaatcgaaagacacaaatatatataggaagatgtcaaaaaaagagaagaaagatgaaatttttttttaaatcgggagaaagtaaacataccctcaatacttaaatctcccacaatgcacaacaataaacctgccctgatatgggcactgccagggatatactcttctccctttctgtctctgagtaacaacaggttgcaactagtttgaattaaagagcctgcatctgcagccaacagctggaattcggcaactgttgttaatccaccttaattgcttattattctatgagtccttgtttgtgcttttgttattcaaagtaattttccctacatgcacatactaccaagcatggttttagcaagctgtggccaaagaattcctgtgtttccatcctagggctgtcattgttttcttttgaaacaaaaacatattgacactggatttttttaaagggttagcaagttagcagtgatgcccacagatggactagcattggcctatatgtgcacagagatacaggtattagccaacgtctaaataagaacaagtcttcttttggtgttttaattagagctgcagttagcagggttgctattttccctaaacaattcttcccctccttgagttagggagggattttcactccaccacttcattgcactagtgaataaatgagatcccagggttccagggagaaaaaaaattaccaatataaatgcatcaggtgcaaattaccaaggtaaataggcccatggagactgtaaagctagcaacaccaactggaatatctgagaggggccagcaggagaaagcccatgggtcacagtctcagttctgcagtgtactgtgtgtgtttcaacccggatcattcatcctgcagcctgcagaaaggaatccacagcacaaagcagttgtgatttggcattgacagtgttctaactaatgcttcagttgtagcttttctattcccctctctttttattcacccaaatgccactcttggatagtgtcaaagcagaacctccattgtgagagaccaatgcaatataatatctccaactataagttgatcattagtaattatttgttccctggaactatttataatctgcaataaggaaaaactgccacaaacatcactattaactgtggtctgtagggcacgaaggctgatcttttacgttttccctacaatgtatacgtatatctgctaaagaaagtatttgtagctctgcatttcttctttctgttgctctttactgcaaagtctttcttgttctgtaataattttgccagggtaagcctagtcccactgtaagcttcacataaagcaaagacctgtcatatacttgtctctcccagagtgcagcactatttactgacctgagttcaatttttttctagaagagagcaggcaaggctttccattagcctggctttgtttccacccaaccctatcctcatatggtgtggctgtctcacctcttaccctcttatacatgtagcctgaatgcacacttgttagtcttatttattaccctatttgtgtactgaagcacatgtcccttaaaaattagcctgctctaccctgactggaacatgaaattctgcaggcatctgagcatatattcaaatataataaaagggctatattataacaaaggtctttaagggatatttgcctggcccttaaatcaccttgactttgtttcttcaaatagcaagtacctaaaaaatattcattaaaaaaaaacaaaacaaaaaggtttcctgtgaacatttcagccaggattgttcatcctgaagcctgcaggaagaaacctgtgaacaagtgagtgggagaattcacagtggagtcagctccagctcctaactcttactatttattcatacctggtgtcgtcttggttttatgcttcctgttttagagcatgcatcaggctagataaggacatattgtgtgcatagtataaactaatatgaggacaacttctacaagccttctacagcatatagatcaagtgtcattcttaaagccacaggcccttgttaaaacaatttatttgcatggattaagcctcacttatagatattgactcaactatatgattttgtaaatatttttttaaaatattctgtttcttacttaggatatttcttacctcctgcacaacacaacatcaactatacaatcaataagatacagtctttagctacaaattaagcttcttattttatctgtgtaacaatcattatgtggtttaatgatgatctgcagtcttaaatacattatatactgttatatcagagatgacataaaagtacagatattatagcttatgaaatcagcccctccttaatcagtttggcaataaaccaaattgccctgatttagcaaagaaattctcagaaactatttttctcattcaacatttgtgattttaattctttaaaaaatatttcagtgtcttattttgcacaaccattcactatttgtttgaaaaacttaaaactgtaatatcattttaatacagtcattataaactaaaagttaagatacatactatcggctacatttctgttgtggtattttaagcctcactttgttgaagcagcaattattttcataacctgaattaacgaatgctgattttgtacgtgaaaagatggacagaaatgtcacactttaattcacgccattaaacaaacaaaaaacggccataaggtcaaaataatagaactagatgaaaaaagtagtcgatctagaatcctgtgaaattttctctgatttaaactgtttcttgccttaaagaaaagtactgcagctgtgatacaactatgagccctcctccctttaaaagctgatgtcagtgagaaataccccatctgatgggttttcaagatgtacaccgggcattgcctacggaagttagttaattacaccaacctgcggctgttagcaatgaggactgcccctcttcacccaacgtagggcagaaaccaatcctctcagttcaccgatctaattccagttttcaggcacactggccatccactgcctccttcccttccctctccaactcttagaaaacgaaatgcagttaatttatgttcattttatccatttcctctcatgactcactgcaacaggaaactgccgtctctgttgtgtttagaccagtctcgtcttagccacgagctaacagtatcatcatttagaaagatccctcatcatgccacagtcaacatcaaactgttcctcgacattctgaatttatctagcacatcttccctatctgatgcaaatgaaccggcaatcattttaggaagcagtgccttaaagaattgtgatcctgacacaattgctgtggcggtttactcattacattacgaagcacagctgtatcttgttgtttcatctgtggggcttttgacagcacataactgctgaaaagcatgtacatggggttgatatatacacacacatacatacatactcaggacgtgcaaaggagaacgtggccgtgctcgaagtgtatcaaactatgacttctaaattcctttccatcaaatgccagtagaagcacttgataaatggaccctaggagagcacttctcattgcctcaggatggaacgactcgcaggcatacgacactccatcaatacagagagctggcagattgaaaggcgggaaggactatctctgatacggtgcatctgcttactaatagcagcagcactccaaccctcttcccattcattgcctacaggaaccactcctcagagaggcacgccagtcaacagatggtctctggctaaggtgtaatcaggagcagcttgctaaatttacccaaaacaaatagaattacaggcttttgcccgagtctgaaattgaattgagaacttgggtggtggataatggaagctaaaatggaagagctcaaaatgcatcacagcatgttgggaaagggcgggcacagggtgcagtttcagctgtgaactccactgtttactaccaggtcatctattgccaataaacttgtctactatgcaggatcgtttcccctcaagatcaaagcttccaggattggtaaaattgtcaccagttaatgaagtcatctgccttcggtgcacagtgaacaaaatactacctgatgttttgaatatgttttgcccagttgcaatgccttcacgtaaaatgtcaacagttctaaccatcctactttcattagcagtttttatgtccactaaaaatctgtcattcaaaaggtaagaatcattaaggattctgaataatgtgatcttctaagaagaggtgttccgatgtctatctccagaattcctcgctgttttcaatcattcgttgctcagaatacaggcaacataaagcctcagaaattgcctgaaaaagtcagcataaaattaagagtaaatcatttaacctatggctatgtttcactacttacgtagtaagaactgtgccacccacacaaatcactgtatcatgaagctttaaaagtaaatgaggcaaaatatgtaaaagcacttaaattataaagagataaggtcttaaggataaggctatttgtaacccaagctatcagcagtcactttaaaattattatcttcataaccattaatattttttattactaaattgtttacccattaaaaaggccattaaaaaattaaaaatttcagtttctaatattttattgttttctaatcttctttggaaataaaaagatgtgtattttgtattttacatcattcagtatttgcaatgcagagcttttaaaatgtattacagcatgcattgaattagctacctttaaactaataatcaggcaattctcctcattcttcatgacttaaaatcccattatggaaaattcacttttatacatcaatcagtctaacattttcaaacatcagttatataagaagtatctgaagtacctcctattttcttcgagcattttgttgtaaggaactctgccatgcagagaaggaatcccaaaagaaaggtcttttttgttcaggatgaaagtatttaaagagagggtattttttaaattaactaaaaaaagagcttcattcttaaggtttgaattacagactgacaagggctaaaatatcttttaacataattattttttaaagtaactgacttgaaatgaaactagcatttttcttaaatgaatgctgttaagtaaagcaaaatgtgtccctacactcgaagaggatacatttttagtgatatgttatatatataaaaaagaactagatgctaaagctaccttactaaaatatgtgtcttctctatttggagctttatctgctattctctcttcttttatagaaatagaaaatgcattattaatgtacaaataatatgcatgcttataggaacaaacattttgagctgcagaataaactaatgaaaagagcacagacagatacagatatctaattactacattaccctgggcaaatcatttaactgctctatgattcagtctgcccatctgtaaaatcagtggaacagcttccctacctatccccaagatatttggtaggagtacatgaaaaagtgttgtcgaagcctatttaggcaccaagcttaaaaggtctggcacatgtttgtgaaagtacaattataatgattttcattactattctagtagactctgaattttaatctttaggaataaccctaattattttattttaaaatgcttcaaaaatatagctataacagaaaaacctgtcatataactagtagtaaaattttggccctataatatcatcctatttattattcaattattgcttcaataaaccaatgtatgtataaaaggtagcctttgtttttccgtatctttaatgcaatttgttctgaaaaactactgtgacattaataataaaggacaagctctgtaaagaaaaggtgcctaacaaaaacttggcaatgatctccattcaaagcaaaaatgctatgaattttaagataagggacctgttatatgttaagtaaaaatattcgtagtttataatttgtgaagcagtaggcattgcataactctgagaaaaaatgctgttcattatatgaatggcaatttcaaataatatcaaatgatttaagttcaaaggacttaggaaagcttcatggcatcctgttattaatttcacaaaaatttctttagaaaagaaactgagtcctacatgaaaaatgtaaaactacaaggtgcactgtgtactgattctccatgcaacaaatctgcaaacattgcctagggcatgctatatgggaaatctggacagctggaaatcatagtagacaaggagatttaggtcattgatctcagaattggaaaatttcccctagtgagccaatatgaatctggcacatatcactgatacacacacatacacccctcctatatcctcaaaaaagtagcatatcactaagagatatcattagaaaatgtatgcagtaatagcaaagcgtgtgaatatattaactgattgcgtagtgaaaatcttcaatattcagtaaatattcattgggtacctcctatgtacacaacactgtgagaatcagtagtaagagatataattaacatttgttaagtacttgctattctacattctttacctaactcatttaatccccctttcccatctctctctctttttctctcccccccaccttctcttggagataaaaaacaattatgatcatcaacatcagcatcatccccattttccatttgagaaaactgaagcctaactgaagtagcttgcccaaggtgatagagctagtgagcgacagagccaagatttaaaccctggcagtctgatccagtctacacattcaaccactatgctatattgctctaaagcacaaccacagggagccacaagaaacacttcaagctcttgagcacttacgctttatttgtgtacctctcactgcctgaaatgactcccagcttaggactcaccagctccatgaacccttcccagatttccctcaggaacagttgtctactcccttctctggtccatcaagatatcttgtacatattccaaattctgtacttattggaactatattataactatttgtctgcatgtttgctctttttattcgtgaggcttggctgagaattcaacacatagtaaacatccagtagagtaaatgattaacctgtcattggaacattacaatttagttgaagaagtagtctgaactctattggtgtaagtatttgtgtttgataatggcaaataagaataaaggttaccttagcaaaggttgctaaattatggactggggtgaagatagggctcaaacctcactctgatagaccttaaaggataggaatgaatcagatgactggaaaagaggagaggcaatctggggccagatgagcaggagcaggagcaggggatttgagaaatgagtgcctgaggcaggtgtggagggtgggcagcccatttaatggcaagctaaggagcctcaaatttattcttagggcactagagagtcttgagcatggaaataacatgatcagaagagcaaggcaggaaaaacagttttggctgcaggaaacacaaaggtgaataacaaaaaatatataatatctagattttgagggtgaaacctactcagaatccttctttagtaaggaaaaagacagctgaaacattcaccacctgctgaaaaaggcttgtctccaagaagcaaactgttactaatagtttttaatgtaagtaaaaattcattaaacatttattgctgctttattatcctacgggctaagaatacagaaataatgcatcatcttcagggataagaatctaaatttttgaaaatgaaatacagaatatggattagagaagtaacataaaatgatcaaaagtttgtatgtgaaggtcagaatgagagagctattattcttatataatatgatctgtcaaaataaaaaaaaacttttgttcaaaaataaatgatacaatcagaaaatgagaaaggacattagaagtaatctaatcccacagcattttagagatgagaagaatgggaggaccagagaagttaaatgatcacctccaggtcacacagaaagttgtcagtaaaatatggattacaaatctcatctcctaactatggttgactgctttgcctctgctgtttttcataaagctataaatatgactacactagaaaaataattctggtatattttggtataaaacaaattataagtctttaataacatccatgtaaactttaaaagattaaaacaatagagccaatgaaaatggatcattcattcatttagcagcctatattaattaagaacctagccagggaatgcaggaatggatgaagggtttggatataaataacggaaaatggcaaggcgtggtggctcacacctgtaatcccagcacttttggaggccaaggaaggaggaccgcttgagctcaggagtttgagaccagcctgggcaacacggcaaaacctcatctcctaaagataaaaaaaaaaattagctgggcatggtagcgcagctgtagttccagctactcaggaagctgaggtgggagaatcacttgaacccaggaggtcgtattttggatatgctgaattaaatataaaattaatatcaccagcatttttaatttcttggtaaaaatgtagctattagaaaactgaaaattatatacatggctcacatatttctattggacaatgccactctggagaatgagcaaagattaaccagctgtgggctggtgcatgcttagaaaggccaggaaagaggacaaggtgggatctaaccattaaaggataagaatctgaagattttttttgaaagactaattttcagggaattgtggggaagaaagtctcacagaaaaaaatgtgggtagttacccaaaagtttctcccatcatctttggaactttggccaaatcaggtgatgccttgggcaaatcaggtctccttcctcctgccactgaactaaacttgcagtttatccttctgtttgttctctgtggaactgtgagccaagtgaagtgcagatggatggcttcttggaacagaactgaaagcatgccagtacttaagttagaatagcatccaccttcagtgaccacagttattatgtgaacaccgtaggtcctcacgtgtgaggtcaccgtattatagaagcagctctctggataattattcacacagacacaaacacacacacagacgaatgtcatcagagttttttgctgtaaaacactatttccatctgtgtcttctgctgcatagtttaattcctgtatatgtcttttaaataaaaatgtgggcctcatctgtgttacaccaaccttgaagacatgaactgcagacaaattttcataataacttcagggctatcaaactggctagaattgaaatatcaaggtcagccctgccattttcaaattatcttcagccttgatataacaataatcttaattaaatagacttctaaaaactaagtgtaagtcaagcttgaaccatcactattttcagagtatactaaacagctagtaatacaagtataagcaataaattattcttgtttttataataatgagaaaaaagttctagaagttaattccacttaaaggtgtttcaataattaataatttcatttttctcatgtccaatgtcattacagaattaggtatattcattacttgaaacatttcatttaatcattcacttatttacttattgcagtgttcctttattgtattgcagttatttgtcctgacagtttatagttcctcgattaaatggatattttaggtattctggttttaattacctaggagcaaacttcaggtttcaaagttgcatttggacaaagtgctattcctataaatttatttataggatggcttcgctcttgagttaatcagaatttgtgtcacttacataacaatggtgactagcgtgacatgttagtagtctctaatgcaattttgctaaaaattttcttataacccattaatacataagagcagatgtctttagatacccttttacagactctttaagatgactatttgttcttttcatctgaaagaaccaacacaaaagagcaaaagtgagtgtcaactctttttcttttccttttttttttttgttttctgaggtggagtctcaccctgtcgcccaggctgcagtgcaatggtgcgatctcagctcactgcaacctctgcctccaggattcaagcgattctcctccctcagcctcccgagtagctgggattacaagcatgtgccaccatgcttggctaatttttttttttttttttttgtatttttagtggagacggagtttcaccatgttggccaagctggtcttgaactcctgacctcgtgatccgcccgccttggcctcccaaagtgctggggttacaggcatgagccaccacacccggcctgagtgtcaactctttttacaccccttaaaaatatactcatatacagatgaatggttataaatgatttaaaaacgtagatgaggaacactggaatacggccttcacgagggcagaaatttttgcctattacattcattagtatatttctagaacccagaagagtccttgatcctagcagatgctcaataaatatctgtgtattgaatggcacataatggacactcagaacataaatgtttaatgactgaataattcatggaaatgattacgccattagttaataacaatatgctccatgatcatcatttcactgtatgctactgtcaaaggcatttgaatcacagcaactccatcttgaataagggctatgtaaaatgaggctgagagctactaggctgctttcccaggagggtaagagattcttagccacaggatgagataggaggtcaacacaaggtacaggtcataaagaccttgctgataaaacagcatgtggtaaagaagccaaccaaaatccacgaaaaccaagatggccatgaatgtaacctctggtcatcctcgctgctcattatatgctaattacaacacattagcatgctaaaagacactcccaccagtgccatgacagttacaaatgccatggcaatgtcaggaagttaccctacatggtctgaaatggggagtaacctgcagttccaggaattgttcaccctttcccagaaaactcataaataatccactctctgtttagcctataatcaagaaataactgtaagtatccttagtctagcacctcaagctgctgctctgcctatggagtagccattcttttattcctttactttcctttcactttactctagggacttgcaccaaactccttgcgagatccaagaaccctctcttggggtctggatctggacccctttctggtaatactacaatatgaatactttaaatggtggttaccaggaagtcttaaatgtttatgacaagtaggtgcttagtacgttttcttgaatatatgagtaaagaaataaactagaaagactgggtcacaatttagaaaataagtcatgaggtgctgaagaccagaacagcccaatctttttttataaacctcctggatgcaagttttaacacagtctcaaaaaagttgtgatcagtttctccaaagctacacactgagactaggatgacaacgagctacctactcaggattttgcaaggaccaaaaatcttttcttactttacaatactctcaaacagaaactattttaaactacatggttaattcaaccttgtggactggatggtcatcaaaatgattatataattatttcaacatagttgcatttctttctttttctttgtgtgtgtgtgtgtgtgtgtgtgtgtgtgtgtgtgtgtgagacggagagttttgctcttgttgcccaggctggagtgcaatggcacgatcttggctcactgcaacctctgcctcccaggttcaagtgattctcctgtctcagcctctctagcagctgggataacaggcatgcgccaccacgcctggctaattttgtatttttagtagagacagggtttcaccatgttggtcaggctggtctcgaacttctgacctcaggtgatcagcccgcctcggcatcccaaagtgctgggattacaagagtgagccactgctcccggcaccatagttgcatttctaaatataaaatccccacgaagtttgaaaagatgatgagatcagggatatttgaacacatttttaaagtaaatggatgtatggaatattatgatagaatatagtagtagtggtagtcaagcatgaaactggtagagaaacaaaaatatacatgtaaaataaactcagtattttaataataaaataaatggtatcctaaaaaatacactgattttgtaaatctatattttgctattgtgactttctatgaatatccatttataaagtgttacattccaacctgaagcttttttaaaagtacaacaatctttttagtttcaactttaatctgtaaattaagtgccctaaatcatctaatagcatagctctaaattcatccttatcaccactgcctatttaacatcaaaactatcataaaaaaaatagttcttatctatcaatgcatacatatattacttttcttaaaaaaaacctgactaataatgtggcaccatgaacatgttatatgtagacatggtttgttcaaagggctaaaaaacaattatagccctgcctactcacaatgcattcccccaaattttcattagcttacatcatagtaagacttcacaaaattttcatctgaaaagacctactttccttaagatcttgctcacaaaacacccaaaaggtgcattttgagaaaatgaagaaaatgccatgatgctatctgtggctcctgcaacacttgttttacttcctttcgaaagaaatagaaagtcaaaagagacttcaaatggtgggcagatgtaaatggcatttgcctgaaaagacataaagcagcattcaacagggaagtcccaccccactgagtctgtataagcgctcactccatctctgttgtagttgaagacagtggctgtcaatcaatcctggctcagtggttaaagaaccccacataggctcctcagtagggtgtaaatggctgcaatcgcctgggtataagcaactgatttgcaagctgaggggcaaaacaaaacaaacaaaacaacaacaacaacaacaacaacaaaaaacacaaaaacccccaccttgtttcttcctcacacaacctgaaatcaatactctagcctgtttttttttaccttctaggaggtttacagttcttgtaggccatcattacagagagtcacagaaggcacaaaactgaagcatgtcacccaggttaagaagctgaagactttgtgctgatttccagtgattattgccattaaaatagagcaatgagataaagttttgccagagccaaacacacaccatggtgtttttgcaaaagcatatacgagaacttaactccaagatgacagctccatcaagcagcaatcaccgagaatgctgttctgaattcaaaggcaaccctgctaaccactctttctgagtaaatcacttaacttcttttatacctcaggtagttcattgtgcactacctcaccatgggttgcttaccaagaaaacgtaataaaaataattggggagctctttgaagacataaaattgctgtggagagaatcaactgtaaatttaagtctgtgctccttggtgaagaagtctccaagtgagctagtcttgatgaggtctcctttgatgatttggactgtactactcttagtagaaagaggctctgccccttcctgatgggtacttacgtacccagtggccaggaggaatggactcagggatggggctaggggcctcacccaccaggcatgagaggtaatttgtgcttccctggctgccttggcaccatgcctctgtagctttgtttcagggatgacatgcttcagctcaggctgctgtgcttaagtcctactgtagtcagagatttggggctgggaaaagaggggcagctttgccccctcctgagccaagaggagagggagagggagagagagagagagagactctatcaaataaaagcctgttgggatttacaaggaaacactcgcttgggagctcaattaataataaaatgtgatgagcatgttgattctgtgggttttgtttccaaatcatttgctacctgccccatttcagagcatgtcaggaatgggtactctcccactgcaaagatggggaaatgagtcaaagtgtctcacttgtgtagcaagtggaagccagatgtcagaagatgtatgctgggcagatgttagaattttaaaacgagaactacctgaatggccccagcagaaaacatggtattctaaaaataggacaccgacaccccaccgaaatcaactgttcatttatttattctacatgacgggtgctgtggggcaccagcttcttgcaagcctgcaaaactgcttgtgattcataagatgtttctgaacagaaagaggctggtggtatccgtccattaaaaacaggctcttcactgagatactgggctctatgttgttttttctttaattccaagaactcagagggagggacagaaatgctcagtggatagctatggatggatgagcagaggggagaggaaataagtgtgacatgtaagctgatctgtgtgatacagtaagagaggaggatgttgcgaggtaggcctgggtcagcgtcgcacaggtgttggtgctggaatctgtttcctgaacgtctgtgctgaacacaaaaacaaccaggaccacgggggtagaaataacaagtctcacattgctttaacaaaaacaacaaaataaagcactattcctgttttctgctgtttctgtcatgctaaatgacatccctgtccccaggtttagctatgtattttgccacctcataaaaccccaatcaatcttcccttctcttctggcaccaagttatgaagcatccctgatcttccagacctaaagaaaacagcagagagacggggctcctcatcaggtagaggttttcttttttgtcagaatttgagactaaatacagattggagtattcacttgggaattcaacagagatccatcttaaggaacattccaaatacacaatcagaaagaaagcatttgtgtgcttttctgctcctaggaaaatgcagagagaaagaaaaggttactgtttcatgtgaactgatttctcccttctctgtggtaggcagagaacacatcatcccacctggaacgtgagtcatttgtgaaatgcttgttttaaattcaaacttctccacaacctgacgagtgtgtgggagacccaaggaagctgacatacaagggcagatttatttttctgccagaaggaaccatcaacacaaaggccaatggtaaccctaaaaatggaaatgtgctaaccctttttattgtcaagcaaataaaaaaattattcttcaaaggaggagaaacaaatgctcagaccctccaatggcttcctgtctcattcagagtaaaagcccaagtctctacaaggattctatgaggtcctacgtgacctgcctcccgtctcctctttccttacttcactgacttaatctcctacctctccttatgatataggagttaagaagaaattaggcagatagcaagggcatgggagtccttgataaggcttttctttttaatgaaaaacagaaaaacagccccaaatcattttctaacaaagagctgcctgcaagctaggagcttgcatgggtgaatgccggcaggaactaaggactagacatgtgcaggatggcagctccatcttcctttctctgccagccacgtgtactgtcaaggagcagacaagatggtcccaatcaactagaaagtccacttgcactgtaacctccgccttctgggttcaagtgattctcctgcctcagcctcccaagtagctgggattacaggcgactgagccaccacacctggctaatttttgtattttttagtagagatggggttccaccatgttggccaggctggtctcaactcctgacgtcaagtgatccgcctgcctcagcctcccaaagtgctgggaatacagatgtgagcccccatgcccagcatcaagacatggtttttattttttattttattattattattattattattattattattattgagatggagtcttgctgtgttgccaggctagagtgcagtggcacaatctcggctcaatgcaacctccgcctgctgggttcaaacgattctcctgcctcagcctccctagtagctgggactacaggcatgcgccaccacaccaggctaattttgtgtttttcgtagagacagggtttctccatgttggtcaggctggtctcgaactctcaaactcaggtgacctgcctgccttggcctcccaaagtgctgggattacaggaatgagccactgcacccagcagacatggcttttaaagtgctctgttttatctacttaaggcctggactccacaaatcaaatcaatgtgttataatacagaactctgggtacttcctaatcttataacctcttcctactcatgctcacgccccaaaggctatctatctatgagatatgttgtacacaggagaatccaagcccaagaaactaaaaatcatcccaaagcagtttaaaaatgaacagggtttattttactgtagagcttgttacatcatccatttgttgaattaccatttatgttgggttacttatccttacaattcaaatgacctacagccctagacactagaattttatttcatttttgagacacagtctcacactgtcgcccacgctgaagcgcagtggtataatcatggctcactgcagcctcaagtaaccgggctcaagtgatcctcctgcctcagcctcctaagtagctaggaccaaaaatgggcaccacaatgcctggctagttttgtgtgtgtgtgtgtgtgtgtgtgtgtgtgtgtgtgttaatttttggacagacgagtttacactatgttgcctaggctggtggcaaaccctggccttaagcaatcctctcgcctcggcctcccaaagtgctgggattataggcctgagccaccatgcctggttgagttttattttttttaagcagccacgatatacaggaatcaagagaatttaatcctcaaaagtaaaaaagaaaaacctctatgaaaggaaatgacttgggcttgtgtctatgtagtgcccaaaacaacctgttggtctgctaatctgttaatcaaacaactgttttaactatattatgagaaataaccacttcaagttatttttgtttttatagaattgacaactcctgttcctcccaaactgcttctttgatacactacacatatggccgtaaaagaaagaatgctttaaataccatgaagcccacatctaagtacttaattatctgggaagcttatgatgatggtgatgatgttttccctcaatggtaaatctaaaccatgtgtgacagctgcaaaccacagcatttatttagtaaagccagggctccttgctcctctgtaggcttaggaaacatttcagtgatgtctgaaaaataataaaatatgttacataaaagtccaatatctagaacctcaaaaatattatattcagtgaaagaagtcagacataaaagaacacatattgtatgattccatttgtacaaaatgtcccaaaaaggcaagtatatagagacagaaaatagatgacaggctatctagggctgggggtaggcacaggggatgactataaatgggtatcaacctttctagaatacacacgtcataaaattatatcgtgatgactggatggctctgtaaatacactaaaattcattgattgtacatttacacctcatgaattttatggtatgtaaattacatctcaataacactgttactaaaaaaaaaaaaagatggaaaaaagtccagtatttataaaagcttacaggttatagggtgcagggaggagaaactagaagacaatgatgctatctcacagtattcatcatgcaaattatggtttctgttcttttctccactcctatacaatcatggtgactcaggagagggttacaggtgtgttgaagcacagtgataaaagtactgaactccgggccagactgcctaggtcggccacctactgctctgtgacttcaggacaaatcactcggtgcttcttgtactttagtttcctcatctgtaaacactagtaatagtactgacctcatacggttgttgtgaatattaaattcaatatatgagaaaagtttaaaagtgctcactatcattattatccttttagcctcttcttgtgtgcccaataaagatcttggttttctgtatatgccaagatatgaaaatcactgggaaacaacgtcaaacaaattgcgctgcattatgtctgaatcatgttctgtgacaagtcatattacaagtggtacggttatattatgcaatgtatgtgataatgtgtgagaacaaacgaagcaggctacgtaaaagactttttcaaaaataaggttgtacatcacttagaaacacattcttaaggatctattaaactcatattttcattataatctgctaagtatgaacactataaaagcgtttttgtctactcaattgtcagggtcaaagtagaattgggttgggttgattggtatatcttttaaaaatactgtatttttcttatgcaatgaagtgtactcagcagggatccaaactatatatgcaacaacaaaacaggattaaaagctttttaatgaaggcactgtaaacagcattttccttctgctttagaatatttcaaatacaaaattagcaagccccagagactggaatttctgctacaggagagatgaaaggttaactgtctaaaaaggaaagactatgtttgacatattctatttagaaaataaaagggtttcctaataaaagcagaggcccacttgatgcgcctaatgctccttcagtgtttgcatacacaactgagtaattagaaagccccactcggaaaaaaaaaaaaaaaagtgaataaaaagccattgcagacatcggtcccttgtttactaggcttgctggaggccctggaggtcactgtgattgacaggattttggtgttagtaggagagttgataatgcacacacatctctggagaggagagctccggagtcctgatcatgcttaatagaagggcagccactgtggagaacaatggaacaggcaaagcctgggggactggtgggcagaaggatgttcaaggattgcaaatgacgttcccagtcaattagtacccattgggaagccgaggtacaccatgccaaaaaaaaaaatacctaaaaattctcagggcaagaatcttcctttgccaaagacaaggtaccactgtagccatttccattaggtatacttcagtaacctcagctcccccaaagcacccctatgagctgctgaagatcaagtcattttagaaaagcaacactagttcctacaacgtatggcaatgttttcattaggcatggctgaaaggcaaaaaccacagctttgaatcacaaagccacctgaactttatctttttgttctacttgaattcctagaaactcaatggaaagtattttctgtatttccagtcattgagaggaaccatgttaattattcccaaggttcctccccttaaagatccctgtgacccaaatttaaaaacaagatccaaccggtttcatttgatgtaatgatatttgagatgtgtggttacagagaataaatctatttctataatatgttattacattagtttaatgaatatgctttcaaccaatgaagatattcctcttccagagacacaaaggtagttgccacaagaacttgaattaccctgtcgttgttcttcatttccacttattaatgagatcatatattagctgttgcccatgcaaagttttaaccatcaaaatatcctaattctaaaagtcggaacctagtgagcagaatcatggtccaattgttgattctgcttatagaacatcagttaaaactgcaggagtacatgtgctgaaatgtagatttttacaaaatgggctgtttaccttttcataactcctttgctcaaaaacacaggaccatttattgaggcaaaggaataaaaacaatcttgtcttgacaaggtcacaccaggttttcctagcttaatccttttggaaaactttttctcacttaatccatttcatcctgtagaaagccctgttcagaatttctatatgatactgaaacaataaacagacatgtagggtgtcaaagttctaagggaaaaacatacagaggtctttgaaagagtgtcttccaaaataaaacactgagaaaacgattgttgtttctttggggcatggagcgaagcgatccccttggaaagcacacactgcagaaaatgtaaaattagacatctacctgaacaccatgacttagtctaaaaaaatatgcaactgtgcttaagtgaatttatttgaatatttttactttaaaaataagtaattttaagaaaaggagagcagttagtgcattttcattctgggagcttcaagtcacatcaaaatcttcacgcaaagtttcctttctctttgaactgtaagcaccactctggctgggccaggtgggatgaagtggagcaacagcgacaaagcacaatgacttactttcccattccatcctgatttctcattcatgctttgtttcctttctttaaaggggggaaacagccctccattcatttgctacaaggtccacagaaccatctcagggcttacggggacagtgtgtcaccagggcaactgaaataaacacgaaagacagatgtgaaggctggaattcttcaacggcaagagggtttgacacttcataaatcactgtgtcactctgctataacaaaaactggtctcatgtactgtacccgaggctttctctcgctgtacttgcttgtggagtctgtttgcataccacatctggtttgtcactaaaagctttataaaggcagtgaatcaataagagtgagaaaagggtggggcccttcactctcaatacaataaagtcctcttaagaaagaattcaagaaaccagttactaagaaaataaaaaactaaaaaggtctcagataagaaatgaaaatgctttcaatctgaacacataaaaaagcatgatcttggttatctggctactttcagttggctatgctgttctcaagatcacaggcacaaaatgttgagcatctatttgtatctgtgtctaggtgagtccaaattaactattctgtctttcatctggtaggcaagggggagctcctagtggagttcagtttatttaaaaacataaatgtttgttaggttgaaccgaataagtctgccatcttatgattttcttctgaagaggttacgagaagagctggccttcaaactataattagcaagttttcgaggatgtgtgagtgtttctgactgcttggtaccaaccagatctgccttaagcagagtgaatgggtagtaatcactgtggatcaagatgtatttgctgtttcttttactaaattatcttaacagtgatagctcagggtacttagcagtcattcataccctggtcatgtagtcatacacaatatttaaatgtatcatactaaagaaaacaccatttgtgtctattttccaagcttccattctcttacatttagtcaatttaattataagataaatgtaatatgatttgaaatctaacttgaaaataagcatgtgccatttcaccattagacctatacagatgctcctttgacttatgattggcttatttcctgataaacgaactcattgtgagttgaaaattattgtatgtagaaagtgcatttaatacatgtaacctacaaaacatcatagctaagcctagcctaccttaaacatgctcagaacgcttacattagcctatggtttggcaaaatcatctggccacacaataaactttagagtatgtatgtatgtatgtatttacttatttatttatttatttgagacagggtctcatctcgctctgtggcccaggctggagtacaatggcatgatcatggctcactgcagccttgacctcctgggactcaagtgatcctcctacctctcagcctccttagtagctgggaccacaggcatgtgccaccacacctggctatatatatatatatatatatttttttttttttttggagagacagggtttccatatgttgcccaggctggtcttaaactcctaggctcaaacaaccctcccacctcagcctcccaaagtgctgggattccaggcatgagccaccaagtactagttgtctaccctagtgattgcgcggcttactgggaactgcaactcactgttgctgcccagcttcgtgacagatactgtactgcatatcgccagcctgggaaaagatcaaaacccaatattcaaagtatagttttgactgaatgtgtgtccctttcataccatcgtaaagtgcataaattgtaagttgaagaccatctatatattattgtatgtctttttttctttcttagtcagttcccgctatgttttccaggctggagtgggcagtggctattcacaggatcagtgatcattgcacactacagcctccaactcctggcctcaggcaatttgcctcagcctctggattagttaggactacaggtacaccatcttgctaggcattttatgctttctttttctgttacaagagtggacaaatcatcctcatgcacctaacaatattatatagcaacggtccatagtattttcaagaatgaaaactcttccatgaagcagctgtatttctgttatctgaacactaaaaagtacaacatgacaaaaagtactctagtgcagtaactttttatatgaatttgtactcactagcatgcatattattgggggataataatgctacatgtattctaaggcacatctgtacatgttttattagtcacccatcaaattttgtgatacaaggaaatgtgaagacctctttgaaatatccatggggtcacccaggactttatgcctcacagagccactaaaacctatgtctcctggctctttctcactctctttctttttttctttgtctttttttaaagacacagggtctccttctgttgcctagactggagtgcagtagtgtaattatagctcactgcaggctggaactcctgagttcaagtggtcctcacacttcagcctcccaagtagctaggattataggcacgtgccaccacatgcagctaattttaaaaataaattatttattttttttagagacacgatctcacttgaggtcgacgttacctccagtgatccactttggcctcccaaagggttgggattatatgcatgagttgctatgcctggcctctttctaatttttctggcctcagtccaagtactactgcatgttggagtcaacttcattgactacccaagccacttgggtaactttcttccagccactatgctctatcacatttctggtttttatgaactatattttttattcaaactcatcacactctctaattcttttgtttattcagttacttgaataaaggctgtctgtatcccccattcactaaatcatgggaccttgcctttttaacaaatagatgggtatttccaacacctaaacagggttcatcaaatgtaaagactatttaatttccactgatacagattccacaagacagataaagcaaagagacaaactggcttaatttaccaagttaatatcactaagctcaattagtactgttttttcgtttgtttgtttattttaaccaactatggccaatcttcacacagaccagacaatatttctcctcttttagtgtgttcttacctttgcttttgaaagattttacatatgccagacacctctggaagggcagctatcttagtattatccagagttgggaaatagccatgatatcattcagttatgaaaatcagaaatatgtgcttcctttttttttttaagaaatagtctcagatattcaacttgtttgtcttagatttgcttaaaccccaaacaatctgtgtttaatgtttttggtgtcccactgctttgcaagcagacataccacttgcaaatgtgccagccctttgtgcaaacacccaaaaggctacatcagatccaaaagctctggctcacaagggggccagcaggtggagagcagatgaatcagccatgagtgtgtgcctttcggcctgctaagaaggaagacagtggcataaagagagtattatggttccaggcacaacttcagtctgtccaagaggctctatcgttaacggagaatacagagattacattcagttacccgaattctacaagctttctgtaatgctcaaaaggtttaagtgcacttatctgtcatcccttcactttcctttttgaaataaatccctttgtaataacaaatcagactttccttcttctctttatgcaggtgagcaatgcatgggtgcttttatatttagctggtagggaagaatgacaacaggtagcagaagcagactgtagattattatttgcaattaacaataggagatatagctcccttcttaccttccaattcatttctctatgctaatagaaaataattaaactgcacagcaatttaaagtatcaggttgggttctgaatgaatatctttaaggttcatgatagcaattaatagattcctttttaatgccagttgtttagatcttgataatcaacctgttgggttcttctgttttgtaattcatgtagttagtcaaccaaaatgatactatttaacctcttttcacccatggcaatctttaccgtagatgaagtcactgagccacgcacattctaacttgaaattaccatgagtgactctttaacttgaagttactcacctatgttcctggcaggccagatttgtgagcaaaaaattcactggaagtaacataaagccattgtgggcaccagctgtcccagtaggagcaatgagggagggatattaataatggcaaaacatagttgtttgcctggtcacagaaaatggcccacagcacaggttgagtgagtcacagctgatcaaaaagtgcctcaaaataggaaaatgtctaagcatgttaaaaatgcaacaacagcttcaggtaggtgaaaaacaataggcaagctatactatttatacatcatctactatttactccactaatgcaaacacattttttactactggcaaacagagaagaagaaagttaactacatacaggtctaatgatgctagccatactgaatataggagaaaactgtgaagttatttgcttcactaaaagccaaactgggtttttacacattaggtaaagtcaaacttcatgattaaatccaaggagaggtaactttccttgatatcccctcaggcctagagtgaaccagcagaaaacccagaagtgcagaagggatgtcctttttacagcatctatccacctttgcctatagtgataccacttttgcaattttagaaactttctggatagttgcttcatactcagagtcaccctagaaatttcaatagtagtaaatattaaacttctaaaaattagtagcatgcaagctcccagttttaattaaactcatactgttaatgcagattaggcatatatgtttatatcatacacaaactgcacttctgatttacatgtattaatcttagagtaatagcaaagtataagggaaaagaacacaagcttgatgacctaaagggattttacattcagatccagcattgcctgagagacttttgacagaaaatttaacctctctgggcctctgtttcttatgtaaaaatgaagacaattatattacaactttcaaggattatgagataaaagagattgtaagattagtgggttaatgactgaagaaattacagttcttggcacatacagttcttggcacacagtgtatatagatatgtgtgtgtgtatatatgtatatataaaatgtatatggcatatattcaatatatgttgctgtcttatctcttttttccctaattcatatgttaatgtaaatggttcaattttagtttatttaaagccatgagcaccttacatttgaccaacctccatgcagttgaaaatccatgtataacttctgatttcttaaaccttaaatactaatagcctattggtgaccagaagttttactgataacataaacagtcaattaacacatattgtatttttttatgtattatatactatattcttacatgctagagaaaggaaaacattattaggaaaatcataaggaagagaaaatatgtttactattcattaagtggaagtggattatcataagttttcattctcatcatcttcatcatgatgagtaggctgaggagaaggagaaagaagaggggttggtcttgatgtggcagggatggcagaggcagaagaggtggaagaggctgaaggggaggcaggagaggcaggcgcacacagtttaacttttattgaaaaaaatccatgtgtaaatgaattcctgtgcttcaaacccatttcggtcaagtgtcaattttacttaaatttgaagcactaggaggtctctgattttcttaaaacctaaatctaaattttctttcaaagtttttatttagttagcaatcatatttatactgtactatagaagatatttatgatggatacgggaatgaatcagaattgcccgcaaaggtcaatcaaaagaagacataaggccattttgtgtatagccagcaaatacggaattacagaaatcaacagaaacttatctattattttgtttatccaaggagataaagggatccaggaagttttctactggctcaccatgagccctatgttattctagaatgattatagattcaagattctggattttagaatgacaacattgcttcttgcaataaccattaggtttcaactagaagactcaaagacttcaattggaagagaagcctgatcccagttctagctctgtaggtctacagtgagagttatatttcctctgcagcagttcattccagtgtaaggtttgcctgaaaacattcttcctgaaaccagggctgggccatacatgtggtctctgctcactctgacaggagaaagcaaacagcccagacttgattgggtctgaacatggccaccctctgtgactctgctgtatttcataaggcaaaaagtatatgagttctgcctttctagaaatcatctttatatgtgcttttctattcagtcatggattataaatagattctctgattagtttcccaagtgaaaagtatatagaaaagaacaggatttacttctgaatgtgaaagtacattattttattctaacaactaaatcagtagagcagcaagttatccctaggagatcagaaggagagcaaattcctaaataataaggtcatgtagtaaaaatggaagtatgaggacaaaatgtaagtgcaatgggaaattctactttcttcaatatagtaataaaatagcttacaatgccaggaaaatattataaaaccattagaaaagtctacaagttatgacaagatggcttaaagtggaaaaaaatagggccttcacctatgctgttcttttaatatattgactataggtaccacatgttttgatacagaataaccaaccatattagccacaaaatgccagatttttactttattttctcctggataaatcaggaaaaaatacctttgtgttgggaaaaaatatttgtgcttttattccccctaagtttctggacataaatatgacctggcattttgtctattagccagaaaaccaaaacatcccatgttcttgttttgtttcatgtatgaaatttgaactgcaaagggtataatataatcatataagtagatgtataaatgggttattcagataaactttattttcttttaaaacaacctttttttcttttttcttttttttttttgagatggagtctcgggcactgttgcccgagctggaatacagtggcgcaatctcggctcactgcaacatctgcctcccaggttcaagcaattctcctgcctcagcctcccgagtagctcggactacaggcatatgccaccatgcccagctaatttttgtatttttagtagagatggggtttcaccatgttggccaggcttatcttgaacgcctgaccttgtgatccacccgcctcagcctcccgaagtgctgagattacaggcatgagccactgcacccagcctaaaacaacgtttaaggttcatctagattggggtgtgtgttaggggaatgggataagagaaaataatctcaacaatcctaaaatcattctattgttaaaattaattttccttttcagagtagtctcatgcacattatcttatttcagatgcccaacacccagatgtggcaggtagggaagtttcataataacctcatataacagataggaaaaccaagatgggaacatgtgaaaggaaatgagggaggtcagggaatgactgacaacaaccacgtcagggagaaagctctgactccggggccttctcctccccctcagtacatgaaaaatgtcacaactttctcccccagaaatagaagttatcccaaacattctctacaaatgttacttcagaagccagcaaataaaatgactttcaggaaccacagcttggcaaatagatggacaggaagaaacagtgtcaagtcactgttagcacaaaattgcatctctacattggcacggagctggtaattgacaggcagtatagcaggagttactcttcagctctgtcatctgcaaaatgggaatggtagtacttaccccgctcgcctcaccaggctgctgtgacaactgactgtgataacaagaaaaaacctccatcttcatccccagagcttgatatcaaaacaactaagccagaaagaagacctttggtccttacctgatgggacactcattataacaggagaaataataatgtcttttacaaagctacagacacagcttatttgtgataagaaaacagttttgttttttagtttttttattggcattaatttactcagaatatctactaagtgcactaataacttcataatattaaaaaaggtaaaattcagaattgaataaaaatggaagggtgaaatgtgcttgatcactcagttaaaccatgacagtcttatatgtgtactgtgagtttaaagcaatagtctcaaaagcatgaaaccacctagctaacttccatacacctctattcttggttgtattgagtttgttaattttctctctggattttttcacagctagaatggtcttcctaaacacaacaacaaaaactacttgaaaaataatgtttaacatttctctcagtgatatcattatggtcaaactattgcaaatgaaatttaatattttaattatataataagcactgatttaggtatggggttatattattataagcaataaattgtgactgataggtatatagataatatgttctaggcctttcaaactttgtatcatgacccatgagtggttagaagctttatttgtatagaatacgactgaataaatacatcagagttacttacatattatgaagaaagtattactttcatgaaacttttgtttcaattatgtatatatgtttgtgtacatgtatttgcttggccatttacaaaactaatttcttactatgggtcattgtaaaaaaataactgtttaagaaacactatttagggtatacatttcacaggttgtttttcttttaagattgttccgagtttatttccattttctcagtaattaaattagccagctaatttcaatattggtagataaatggttgctatgatttgaaaaactagtttgaaacattgggatgttagaattaatggtgtctttcaaatcattgagtccagtgtactctgttcacaggtaacagaggtcctgagtagtgaagtcccccctacccaaggtttgttaatgtctgtactagattcaatttatgcaccaggtcaggtaaactctagctgccaccgtagcccaaaaaaaccaactagataagtatagctcaccatgcctgcacactgtccaaactggattctcagaggatctggctttcccagaagctgcctggacactccaggcagcacaatctggaaatgcatgggattttgaccattgagagacaggaaaaggcatggaggcaacagatggattgcttgccttccttctctgcaccaaggcagagtggttctgaaatgcaacctttttggtgccattccacatgatcaagtgaccacttttgttttgtgctgaagctatggctgttttagtaacacaccaccttgtattgctctcctatctttcttgcttcaattcatttttctcctcattcttgcttccctggaactgcatggccaacccccttccctccacaacaaagtattagtatacaagccattgattcatgctgtgctttctagggagcctaggctaagacagcatcctacatacaaatgcaaattccactgtgtattaacaacttacataatgagaaaatagaggtttcaggtattatctatacatgtcattgccttatgtactttaatctcaagaacatttttaggttgagtgcaaattttctatcttttggtcttaaacaagggttaggatttattacagatatcttacccatgctctagcttcgttaagctagttggaatagtcaggataggctagattatgaagcagtaacgaccaacttccaaatttcagtggcctaaaataataaagatttatttcttgctcacactgtacatccactgtaagtcagcaaggggctctgctcattgtagtaactcagggactagggttgacagacaactgctatcttgaaagttgtacatggtcatgccagagagggagaaggaatggtgaagcacatactgcttcttaaagctcctgcctagaagtgacatgggtcaccttcactcacatttggttgaccacagctaatcacatagccacgccaaatttcaagtgggtgggggagtgtaattcaactatacacctggcaggtaagagaaacaaaacctctgtaaaaagtccaaagagctaccacaaatagtatttggggtaagttatctccactacagaaacattttgctcttgatgtctaatccatggattggctgtgatttcaaatggcctgcagaaaatattgaaaaatttggaaatttattttaaaggccaaatgaacataccaaatttaacacaggcatcaaggcagagtgagaagaaggacagagtgggagatctgggctcaaagcctggttatactgcttactagtgtcatggcctcaggtaatctcttaatgactcccagtctggttcccacacctataaaaggggaagcaacaattcccacctagtaggttttgtgtaaggatgagaaataatgggtgatactgtttcatgctgtgactggcatacagtaggcacctgataaaaggcagctggtactgatgggtgtttacctgggacattgcctctcctgtaaagaagtatccaagtatatcattatttctttttgccatatttgtatactttactagtatagatgcactactttgtaaagataattttttgaattaaatttgcaataaatcaaagctgtagaagatgacagatttagaactcactaaaaatgccctttaacgaagatgttttttaaagttctagactcaggttcaaaaaatgtcaactacacaagagtcaaaagagggataagtctctaacttacctaaagttcatgtgaattaatctgagggattctggttaactgtaagctcaccctggatcagtgacacacagctgcctctcaagccctaggtagacttagctactttaattaacacctagaatccagatgaaggggtgtaaccaatgctgtacattttaactcgtatagccagaccacgtacttactgcagtgctcagggtgccaccttctaaacctctactgacaaatgaaaggggcaggcaggacggtgaggctgccgaaggcaggacagatgaggaatgcctaaaaaaactggagacatttaggctggaagagactgtttcaggaaacgtgatacctatcctccaatacctgaagggctgtcatgcagaatagatctttctctgtgccaccctagagaacaggaggaggacgaagaggtaagaattagcccttgactactggtgagctcatggccaagcagaagctggctgctgacctctgggaatacaccagtgatttggatttctaatgtgttttattccccaaccttacaaatctatcagcgtttgggtgtgcagtacttgttctaaataggcattctctccttgccttttcaataaagacattatagaaatactaacgtaatgtgcaggaattcatttacactgcttatgctacagaaatcttgatttagtagatatcccttcaggttacaatttctgctgctggctgcaatataataaagatgctgacagttgtgaattactgagttctacaaattatcaactgcaatggtaaataggagagaaataaaaggtaaagtaggtggctaggtcaccaggggtgatgcctgcctttctgaataatgtaagacctcctgaaaatgatggcaaatagatgcccctttctgaggaataagagaaagtatattgggctctaagtttcaggacatagaggttaatggaaaatgggaacggctttgttttatgagccccactgaagatggatgactggggagatgggcaggaggaattatttcttatctagaagaaactggggttaagagatgaggcaatggcgtgtgaacgctgcatgagacaattattagtggagagctttgactaaaggtgaatggcctgctgggagatgggagacatctgataggtaaagtcagtctggccctggggccatgacctcattaatagttaaacaacagcactgaaaattaatgacccacacctgactgcccagtgaaactgcactcctcttcacaactgtccagaaatcctcacacacattccagcagggagtctggctgccagtggttacagcaatccctctaggaattagccgggttaaatgagtagtggcaagacagatgaagaaatagactttatccggcctccacggtccaatgtgggacggaagaagcatggaatttctaagaagtacagactggccatattgaaggtatttagaaaggaaagaccatgaactggtcctctaccacaattggacatgtggaccgaatctgagtgaggaaggctgggcaccagagtgacctctaccccacctgccatatggctgtctgacaaaagcgattcgtcaagcatcctggttgccaaatatgctggctttaaaatgccatgtgaagcagagaatattttaaaagaacagtctaaacaacctcataattttaagtatgaatactttacgccagacacaagattacctaaggtgttcacaccactgttaaggtctgaggaaacaaagactattcccccgggtctccaggttgtctgctttgtgcacagatttttgaaaatagagtacaataaattccatgcaccacagctcacggcagctaaagacggagctcctgagatgtaccttttttatttattggcgttggagaagggaggtggtaatgtttcctgtattggatgccttatactttgcagacctttggggactcatctctgctgaattctttaacagctgagatgacagggatgtccattacccaaatggacagcactttctattgatcagggctccacttagcgatctcatttgtcatcctattgtctctcaccttcactgctctcgatatgaagcggggggatctttttttcaggtgtgagagagttaatctacattccaagcacaactgagcaattaaaacatgtaatgagcagaacactttagtgcttcacctatagagaagtctgaattgggcttctttctatctcccccatacaggccacaagaagctaaagaggtaatccactcctgaaaaagcccagaagaataactataatacttttcaaaccttagctgtgtcaagtgcttgctttgcttccatttctgctttcagaaactcattttaaaagataaaaaagaatattacaggaagaaagcccaaatcccaacaaaacaaaggaaggtctacctaatcttgccagttaatcatttgggaaaagtcctgctctgcatctaattagatcattagatccatgcagttaaacatccatcaagaattctcctataaaaggtatgttttatgtagttcccatatacggattaaattgggcatgtggaaagcaatgttgatccatttaatggactcccccaaaatatatatcagcatctttgtcacggagctagacggcttctttatcctttcaccaaaatgcagtaacaaaaataattaaacatctctcagacctgaactgcacagtcattagacaatagtcaatgactggaactgccgtgagagcctgaaccacactttaccttggcttttctagccatttctattcggaaagctttccatatctggatttcccctgagaactattttatgatgctataaagactgttaaccagaggcaggatctccccagcacctgagccacacacagaaatatcaaataacatttaattgctggatgacactgtgtgtctgagcttgaattctgatctccaaatattatccatgcaactgtctgcagagataaggttgttatgataacagcagataaaaccaattaaacctaagagcagcaaacacttcaagatcttgactttcaccgtaaatagagtttgaggatgtataaactataaggggtctgatactatcttccttctgtaaggaacattacttgaggcttctttccttttgtgtatatgggggactgcttccatgtaaacacatgagctaagagaaagcaacacatgcaaactgcatgagctagtaattagttttatgtctagtcctggaaagcaaatgacaataaagaatgtaaatctaggtcatctttaaatacataatactagttgtggttgcaataatagactcaaacatgctattctaaatacactcagcacaatttttcccttttcacatttcagaggcttttcttctttttagctgacaacattctactagtgtctctagctgtttgtacacatattatgtctgctttgtgatatgttttgcagctccaaagccaaaacaccaggcagaagtgccaaaccttaacctcaagttacttctggtagaccacatataaggagaacagcactgaattggggtgaaatgaacagtgtatgtgagctccccagaaagcttatcaaaatctgacagctaaacaggatactagcaaatttatcagccaaatgatgttctaaaggaaaacaaaattgatacaaaggaaaatagtatatcttcaaagggagcctgattctataaagcctgaatttctttcatgaaaaataaataaataaaagcataatgaaagtttgccatgaaggaaaatattccattttctttttaaaagtgactttctatatttttggtgtgaaaaatatgatgtaccttcctccacgtatgcctttttgatgaaaagtggaaaaaagtcttagtagctatttcatttagctatgtctcacacctggggtataaatagagtataataacctgtattgtaaagagaggagggtaatggcagagtggcattcaacagcggtgggtacctaggtaggtagacagaggactgcagacttagaaaggaaaaataaatgtcacatacactaggtgaacaatgactgtttgtagatttgggagaaaagaggttggaggcctaatgacccccacctaacaaataatacagtatgtggtttaaaaagtaggcaatttgccagtagtagcagatgataaataatactgaagaacttccaaataatcttcctccaatatatgggcctgattacacctttactaagactatgatgatctaaagaacaatgcagaaaaacatagagtcaaaaataaaacaaaaattttcaaagaatggaaaataaaactgataagattaatcaaatgataaagtttgaaaagaaaaatatatttacctttattatatgacattatttttatagaaaacagaaactatatattcttaaatttaaaatggaatatagagccctctaactgcagcataaataatttttattaactataagaagtttctagatttagaaaagtcaaaggcaaataatgtagtgtctggttcattttcttactcgatgacagttttttctcgaggtcgttatgggcaaaattaattttaattaatgttagtcatgaagatcatcactatcattactcccagttaatattgatggaacatcaatactgtgtgcagggtttagaggaaatactaacatggtttgttttataaatagccagaattcctcactcattgtctagtctacacttgtctatctggaaagctcattcttcccttacccttttaaggcacagtgcaccctctcttccctgctgattccctggaatcctctatatccctctccccactagccaagcactcatcagtggcaggaaccactgcttgagccagtttgcatacttttatcaccacgtacctgactgatatgagggaggcattcactgaacttctaataagactcagatgacaccatacaattactccttgttctatttcttttcaacattctcactgccagagaagcagctaagtttaataataagacattaaatggtggcacatggaaatcttcaaataatctgcttgtttcataccattcacctgtagcaacaggccgaccctctacacagagaagaaatcctaatttaatagggacagagcccaggcatctgatattttttctttagcaactcaggtgattaacatataactagggcagaaaattactgacataaagaattaaaacttctttcaaatccttcatttcctaccataagtcactcaactgtatctttatactactggtggtcacatacattgttattagaattattctatacttttgtttcttatattgcatgcctagcacacataggatactgtttataatcttatttctaaaggatggtcaacataccacccttaaaataaagattgatgaattctatgtccaaattcttaaggcagaaggtatttatttaaaatatatcaaacaggagctcaaagtcttgcaatcagcctgccaacatggcaatcaaaaaatatgttttggcactgacaataattcaaaacacaatttacagtttggagacacagggaacacacggcaccctcaggaaacttatactcaataggataagaagtagatttttcggccgggtgcagtgggtcaggcctgtaatcccagcactttgggaggccaaggtgggcagatcatgaggtcaggagtttgagaccatcctgactaatatggtgaaaccctgtctctactaacaatataaaaattagctgggtgtggtggcggctgcctgtaatcctggctacttgggaggctgaggcaggagaatggcttgaacccaggaggcggaggttgcagtgagccgacatcgtgccactgcactccagcctggcaacagagcaagactccgcctcaaagaaaaaaaaaaaaaattgaagtagatttctcaaaactaatcaacaattagcaacaacaatttctttcattagtatattggtttataagctaaaaacatttgtctagactgggtgtggtggctcatacctgtaatctcaacactttgggaggccgaggtgggtggatcacttgaggtcaggagtttgagatcagcctgaccaacatggtgaaaccctgcctctactaaaaatacaaaattagccaggtgtggtggcaggtcaaggtgggcagatcacgaggtcaggagtttgagaccatcctgactaatatagtgaaaccctgtctctactaacaatataaaaattagctgggtgtggtggcggctgcctgtaatcccagctacttgggaagctgaggcaggaaaatcccttgaacacaggagccaggagttgcagtgagctgagatcgtaccattgcactcctgcctgggccacaagagcgaaactccttctcaaaaacaaaaacaaaaacacttgtccattcataatcttatttaatcttcaggatgattccatgagagatcatgaacattttactgatgacaaaagtaaggttcaaaaaggtagagtgctttttttagctcacacagttattaggtaacagagccatgcaaaccaaatttctgaatgttttaccctacatccagggacaaacatcacgctaattactgtgcagtattcaaaagaattaaactatggtcgtgagacctcagaggaggttgtaagctagttatggaaagaagccagatacacacaaatgattagcacataatacactggagtattggcaaatattaaatgatggaggtgagtcagctgtcctccagggctgaagaaaaggggtatattgagattagaatggtggggaaggctattttatagggtggaccttcgactgagtcttaaaagattgataaagccattaagcaggaagaggggaagcagaagctcgatgtataatgtgtcttgttatagtcagtctggaaatgtcaggctaagaataattccacaaagggtgcatctccaattttcatttagtacgtagtttgaggccaagaggagttcactacagctgagtttactcaacatagggaagcacctggattcttctctcagatttgtccatccaaattcattttcttataggaaaaataacaatttaattactgaggtacttactgatgtttactgagtacttactgagcctctattatgtgcaaagtactatgcttgccattctgacaagtacaaagcactgtttatgctcttgaatctcactgggcacagacacaaaaatttagatgcccaaattgaatattccattactgaggaacataagaatggtctgagcagtaagtacaatgaatgtacagacaggaagtgggatttagatgagctggatactgacatggtagtcttggccacttaatagcacaagcaaagctgacaaggggggatgagtaaaatgtattcagtaaactcatctgacagtttgtgtagtatctactctgtggtagggtggtgtaagccattggagatacaaatttcaccaggaatgtagagcaggcatagaagattcaagaagagataaagtggttactccacgctatgttcgtaattttgtattccatttgtaaagtccgaattcagctgcaatgatgtcatgtgaacatctgggtcctgggtgtaggggttggaggagaatgtgtacctttctaagcagtggttcctttgaggcattcagcttttctcttttgtcaaggctgccttgctttgatatggtttctgtatttccggcttatacaattaacaactgcacacatgggaacaaaagcgactgtcacaacattcacagcttgtgaggcataagacacagagtatgcactggtacactaatgaaaaggcagactttaaaatcccattcataccccagaaagttcacagcacactgacatgtccttgggagctgcctggaaacactgggttctttgaatgtggtcctgatcattttctcagaaagataatcatgccctacatgcctggactatttaaggccacatgtgctaatttaatttacgatgctaaaaagagctgcaccatttgcgaaggcagtggaatgcaaagggctgctccgagccctgtacacacaagggatccccctgatcctctgacactgggaaagagagagcaatggaaaatactagctgtggcatggctgtgggtaatagtgcttaatccatgaccactacaagcatggagatatgcttggaagggaagtgagatttaagcaggggaaggagaatcactgacttggaaaactgtctcaaaaaaaagaaaaagtcttgctcttttgcccaggctgaagtgcagtggggtgatctcggctcactgcaacctctgcctcccgggttctagcaactctcctgtctcagcctcccaagtagctgggacttcaggcacatgccaccatgcccggctaatttttgtatttttagtagagacggggtttcaccgtgttggccaggctggtctcaaactcctgacctcatgatccacccacctcagcctcccaaagtgctgggattacaggctataggcacaagccacagcgcccggccagaaaactcttaaatggatacaaaccagtcagcataccattggtgactctatggttatttaactctatggttaattaaaaggagaaagtaggagagggaaatcatggaaagaatcattcacgccacagctagaggtcagaacaggctttcgaatgtggcttttgaagtcacaccttagctggtggcttcctgcctcaaactacatgtagggatccataaggtgcaacatctgcctttcacacagaaatgctcatcagcttttccttagccatggactatttgttctaaaggattctaagagggtgaaggaatgctaactccttagacagatgatctgacagatggactcaagggaggcaaggctctatcctgggggtgaagagggggagggggcaagagtcaaaaagcaaacaaggaaaacacaaagggcataacattctcaagctttatgaacatacataattatgcccataactaaaatacatagtcaagacagaggaagcacaaaatagttattctaatgtataatctaaaaccagattgagaatgcatgacaaaacctgtttatataagtttgctacggctgtaaaagaatacaatataaaaagaatcccatttattcttgcacatatttaaaaaaggaaaaaagtctcattgaaatgaaaattatgtcaccgaacaaaagctgattatctgctaactttctgccctaattttatgaaaacagtatggcaaaaaatatgagcagattgaagaaataatgtaattgtataatacatatgaaaatgttcccccaatcaatgaggtaatcaaagatatagaaagtcaatcacttttgctataaattattaaagctaatgaaaagatcactcaatactctcagatgctttaggagtaaaaatttgtaagaacttatcaaaagcattattcaatatacttatactttaaagatcttaaaaatgttcacagattttgagtgagaaagcctaattctgggaatctaccctaaggaactcattagaatatgaataaacatttctgtttagaaattttaatcaagaaaaaaaattaaggctgggtgcagtggcccatgcctgtaatccagcactttgggaggcagaggcgggtggatcaggagttcgagaccagcctggccaacatggtgaagccctgtctctactaaaagtacaaaaattagccgggcatggtggcgtgggcctgtaatcccagctactcgggaggctgaggcaggagaatcactggaacccaggaagcagaggatgcagtgagccaagattgtgccactacactccagcctgggaaacacagcaagactctatctcaaaaaaagaaggaagaaagaaagaaaaagaaaaaaattaacttttataaagatttcaatgggatgtaaaagtaattataataagtgatgaaaattaattattaatataattacataattatattcacggtatgattatagcaaggtagaaaaatcaaacaacaaatgaaaactttcataagtatacagacaaaatactgaaagttaatttatcagaatgccaatagcaattatctatgtgttcttattttacttttaactcattagaattttacaaatatgttacacatgataaatgttataatcagaaaaatgtaatcgaagcctaactctagcaatagcaataaaaatcaccacaaagttacttcatgaattatttaggaagaaataacataaaataaattagattagcactgatatagtcagttttctctagtataacattgacctgaaacttgtgttggttacagattgcactgaaagagccaggtggttttgtctagcaggcaacttctgtgtatgcacacacacaaatcccagattgggacagacacacctcaacttcaagctcagtaaactgaaatgaggaaaaaaaatttcttttgaagtagcccaaagcttaacttatagattttatacttgataagaggatagggaagaaattagagccatcctttgggaacttgactcagtcacatgtgggaaattttcctggttgatctgtagaaataggccagccaccattttaattattctctctgttctaccatctttaaacatctaaattatttttgtattgtaaatgtttggcaaacagactacagttttatttttatatctgtgttgttgaagaataaaagtgaacatccttcaaagtcacaagttctgaagcaaatgatatagaaaaaaaatttaacactgaaaattctgaaaaatcaactttcccaaaacaaatcacgacattttgttaagatctgattatatttaactcttctatttcccatatgctgaaagagttcatatgagacaatggggccacactttcagggggaaaataatatgtcttcttaagtctttctaattttaaagttctcaggatcataatattgtttaaaaaaagtcaaaatcttgaaaaataagaaacaagagcctcctgcttcccaagctgtactgaaaggaaactgtcaaagaataaaaagtcaactctgctaagagttccatttctctggtcctataggcacagtgagaatttcctgtggaaaagacaagtacagctggtgtccaattagtaaaagatggtgatgaaaggatatagttattcagggtctgttctttgaaaatgataatgacctctgatttctaagttccataagtagagtctgccgcctgcatgcaggctgctcataaacttcccactttcctttttctgtctgtgttgttgtggtataaggggggggtgcggggagggggtaggtgctggaggtacagaaggtcatgccttctctgccggcaaatatgattaatgtgtgtacagggaggagaaaaacgccactcacctggctatcagccagcctgactcatgcctctgggcatcttagaacaccaaatatccagcaactctggctggggtctagagagatgtctattagctttcacaatgtctgggttaggaaggtgcttctaatcttgtttgtaataaatattagttcaattgttagaagtgtttttaatcacctaaaaggaagtaaacaggcttgcctcacaacctcgacaggcagtgtatgtgtgacttgttctttctatccggaatcactcggttcaaatgctcagagggaagaaagatggtcataaaataaaagtgttatattaaaaataaataaataaataaataaaaagtgttgacctcacccaggcccatttaccgcactatttacactattgccacacagcctggcagcaccaggaacctgtgttcccaagaaatggaagaggccagcagggaagcacccatgggtctgctccaagcccttcctgggcagggcttcccggcagagttacacaacagctgatacatctgtgcacactcccggagcctccactccgacaggagctaaattcatccatcagtgagaaaacaaagtagaagggaaaaaaagctggggactccaggttaaaaaacaaccacaaaagattttcaaagcaacttcttcaaaggcccttttatatttattttaaggagacatttcaatttaagtgacgttgtcaatcattttctttttcaaatatgacaatgctattttacccctacttctttctcatggctggatggaaatgaaggggaaagttatcttccttacccaaaaaatcacacaaagaacatcttggcaagggcaaataacttaaatgttttgttttcagtgttcttaatttagctattttccattaacttactattgtcataaaaaagtgctctgattaaataaactttatatacagcataccaaatacttttctgaagttatcgtttgggaatacagcagactaaaagaaaggaagagcatgggctgctgctcacaaagtggtgaacatgccaaagtataatttaaaaaaaaaacccttttttcataggaatgaaaaccatttcagaaaccattaagccaaaatgtaggctacaaccataacttttatatcctaattattagccttggtgaaatgatcgtgtgtataacatttaatatgctgtaaaatgggatttcaaataccgaacctataagcatctcttacattccatagattccgaagattaaaaccaaaatcaaaaggtgcagagcggcagctctgcctccctaactccgtgaggggacaggaaatcagggtgtagtgtgttctgggcagtccaggtatttgaaagagaagcagcttgtcaggtgggccctggagggaagcccattatatctgtgggggtcctgacatttggggtaatctaaaccttgttacttgcgaatcgcccctggtgggagggagatttagaatggatgcctccttacccaagcaattagatcatttaggaaacagagaaaatgggcaataaggatctccctcctagagagcacttgctggtgttcaatcagatagttctgacaacagaagatgtggcatttgctgaacaaaacagtaaatgctggggctcagccccacacagggctttgaaaatctctcaacgcgtagtgcacagagcatcacaaagctatcacctagcatccatagtgtccttgaacacctgaggaccaggcagaacaaggatgcatttttttttgtgagtaacctctgggagtaccaaatgcaagggcttcttacagaccaggagcaaggttgttcttgaagagaggttgtgttctgtgaatgatacaaaactctgaacttcaaattacacaaaagtagcacttggaaaaagcaaatgatgaatccttgtaagttctagaaattatcttcagagccaacataaacactttgaaggaataagagcaattcaggcgctggtcctgcagaattaaccactccctcctcagtgttcttgggatattcctcagttatggcactcgtcacgtcaccccatactagaattatttctttacttgccaaactccctgagtgcctggagaacacagaatgtcttattccaatcacaacccaaatatttagcacaatgcttggcatattttaattgctatttaaatataagctgaaaaaaattaagtaactttctcagatatgtgataaacaaactccaaaaaactaccatcatctctgatcattctttaactcccacaatgtctacactgtcattttagttatcactgtctacatccccatccttgaggctgatttgaagccatgtgacttgtaaaaaatccactgatgacaaacataaccgacaacatctaaaaggtgaatgacaagcaaaagcacatgatgtctaccgtctaaagccctgtctatatctcagctgaggaaataaaagtcacacatcgaacctttacttgccttaaagatgtgtgtgaaagccacatctttcacaaacattacctgcctgtcacggtatcagggcttggccgaaggccttagtgttggttcagtaatatcggctgtaagccagatgtttccagagctatgggccacattttcaaaaacacatgcagtatttctaatgatcttatatgttgggtatattgagtatgaaattggttttctaccaatctgattaaaaaggaatcacccgcaggaaaatatttcctgaggactgcaggagtgaaacagaggccaaagaagcacaatgaaaacactgcagttctacctgggttttagcaagtgagccctaaccctgtttcatgaagtaagctacctgtttctatacttgcatccattcattaattaaggatgaggatgtatttatttttccagatgcccttacaggatgatgtggctcctagatggttaattacttaagccaaggtcaagaacctgctatgggaaagccacttggagctcctcggcaacttgtgtttagctcttcaatctgctggcatcaaagggaaattttcaacagcacacaaatgcaagggagttttgttggcaagaagggcctctgatggctctgtaatcaactcggcttcaacaggccttttgcacagaccaaaagcaactcaaacttttggaaagccattcgtttttttcctaatcgaaacactgtctcttgtgtcctaatgtcctgttggaagtgatttctatgaactaagagaaaattttgtctgtagcagtttgaaaacagagcaaatgacacttctgcaagcctgacattagtgttttgtttttaattgaaatccaacatcaaataacatgcctgcaatcagaagaggaagagtggacctttggaaaaatggggtttcagtggatttcactgcccagagagatgggggctgttttccatttcccttaagcgatatcaaaagttgtattttttcaaatacagaagtgagaagcagaaaaaggtagctttccttctcttcctgaagtatagaaaagagctagtagacaagtctcaaaagataacacaatttgtaggggccgccctcctagcactggtgcggctgctctgctcatcctcacaaatcaatctggtcatctccagcacatctgctcaggtgctgacaaatgatgaattccacctcagaatccataagcagaaagaggctggctgataaacagctatgagcggaaatgtatgcacctttcataagcaagacaaatcactcattctcaccaaatgcttccaacaggaacactaattctgtatttatttgcacagcatatgtactgcgtccgaagcagtgcattaaaaaagatctcaggcagccaattgctttgattactttattcatcgtagtattacaagggctcaatggcagagcaatgaaataggaagctagtgaagactgaaacacctcgtcaatggcttgtcagagttgaaggtttttctggtgcgtaaaacacacacacacacacacacacacacacacacacactctcacccctggtgtaggaaagaattttttttttaaataaaatactgtggccatgcatcttaaatttgccatatgcctttcctgtcaaccagcagttatttttattaataactccaagaacatatcatggaattcttttttgttttgagatccggtcatgtgactccttcaacaccagggaacactgggtaaattgtaatgttctaacatgccaatgaatggtctcttttagagccaagttggtgatgaattgatatttgctaaggcctaagcaagcacagggcactatatatattccttcttctgtgctctctgcaatgatggatggaagtaaggagcagaaaagaagtcacacagacaagctcaaactgacaaccaagcaaccaccagtggactgtttcaatcaagctgcaaaagaagtagctttttgtattacttactgtagcttcattcgcctactgtacacatggatcatggatacactgtaccattggcctgtctgaaaattggaatgcagtagaaatagcagaaaagatacaacttccttcgggcccctagaggaaggtcttttaagcaaggcattttcccatagatgccagtacgggaaattcatgctcccatcttcatgagagatctgacttttgagaggaaaatcaagatgggtttgctgttttcctttaataacactcatacctcccaacaacagaaacctctgggaccacaagacaggtgtgatggtgtcacatagtatcctccaagctttgttctaacaacaaagctctcttggttaggaatttctggtttacagtttaaaatgttagcgtaagacactgatgttccaaaaaaaaaaaaaatacaagcctacttcatgaaaccaatgcctgttgtgcaaataaatacagagttagtgtttacccctggcagggcatttttctttgagttggctgcagagcattaaaaaagacattaagtagattatacatttacatgaagtcccttgttatttttaaccataaaaaaaaagcatttttctttttgatgatatatatactaattgtgaatgattacaagaggtgactttgtaagacagtgtaattgtgtttttttcccccacagaaatttcacggtaatgtaactttggtaaaatagcttaactaaaaatctgttattaaaataagtgcttttggcttaaattgaatcactattttttgaacaaataaacaaaaatcataccctaaaatagcattcaatttcagagaaggtggtttattctttatgtagtaagctcaaattcctaagaaggtctatataaaattctgtaaaccctgtctaagttaaaaataattgtgaagaataaactacctttagaaagattctagaagaagccataaaaatcaagtgatttgaaccttcattttccaatgacgacaatgaggtccagagaggcaaactaacctactcaaggaagcacatctaacataactgaaactcaactcaaaattaaacttcagaatccaattcattatttcagttgaggtggagtgaggaaagactacctacactttttaaaaatttttttgaagtttagaaccaacataaattttattaaacaatggacttttaaaacaatctctccccctttcacaccagaacagtatggaaaaattggatatcacatatgcaatgctacattaatggtcaaaatatttttttcctgaaattttgcttcacatttaatatgattatttttataagagcaataactaaaaataaaggaatgctgtagatataccttcagatagtttttttgcaaggtgagtaagtttctaaaaagattgacaggtaaaacttgaaatttgggaaatacgtgcttggattcctgttgtacaacgggctacaaggaactgtcacataaataacacagcactgaaatgtacagctgacgtgagctgttagtaggagcagtgtctagcagaagtaaagaggctgatgctgagtatctgttgtatcagtcctttgttttaaagccagatgtgcaaaatgtgaaaccacctgtcagtttcctcatctgtaggaagcagtctttcaaaggtgtgttggctttggtggattatggtggtaggactagtactccaccaagttcaacagtgtaaagtggaagaagtctagccaagtaaaagtcttcgagaggatttgctctagacgagattaagatccccaaaccctccagtgtctgaattaagtaaaatgacacaattctcacacttagtaagaaaacatatacacttacacatacacatttttgcaattacaattgtgtaattgatttacccaatagtttttccagaatgctttactttgcaggctggatatttcttttctatgcaatctagctctagagaagtaaaaattcattcaaagtatgccaagaatgttgcttcctaaaatagtggtcctgacacatttcagagtaagaaaaaaagaaagcccaaattgtaattgatttacatgatagtttttccagaatgctttatttttctttcggattaacaattaatagtggtcaaaaacactgaggcttttaaatatataggcacctcaccaatttgtctggtaattaatcaggaaagaattacatgctgtaatcctttaacacaaagcagacattatttcatttgatccccacaaagtctttaagataagcaaggcaagaactatcctcattttacaggtaaggaagtggatgctcatagtttaccatactcatattgttaataagtagcagcttgttagtcccctcgaacagactaagagagaagtatccagtccctaagagtaaactggggttcttttgaacagatgggcctggaccatcgaattgtgtgctcatccataccgagcacccacatctttctctatctcacagtcatcaaattcaatctcttcagctctcatttcaagcctgttgggtcccaggcttccacagtggtaagagggaagggagaagggccagtcctctgatgtaggatgcctctgcgtagggatgtccctgtaagagtcctggcagtggcctgggccttgtcctgggatcaggcattgctgccctgagttctggctctggccatgaggaatgagcagccaccttcccaggcctcctatgctgtccagatccttcagcacccatggggttgcctgacccatgcagaaatagcacctctcaaatgtaaaaagggattggttagtacctatggctctctggaaatggaagtcattccttataaggtatttgtctacctttcaacttttggatttttgactgtcaaacacatttttaggacagtaatctgtagtcaagctcattatagggtcttcttagaaaagaaagacattaacaaagaaaactgtaaaatagctgtcatcatgggcaaagtgccctcacatggttccactaaatgcagagatgcttttagatgtgctcagatttctgatgggtacacaaaactgtggtcctgaaacacagggaacaactcttgtcagcaatattctgagatgtcaaatgtcaatttaacatggaaatattataacaagttaataatttaaaagttctattttaatatgattgaatcatataatactaatagtaaattgtcattgatataatcaataagtgtttcctcatctttatatgtatgcgagacagtgttaggactacaacactgaatttactcctcttttgacagtattgtagaggagaatgattatgcgcttaccacctacatcacaggcaaattgtctaatctttctgagattcaacttccccatttttcaaatgggaagaaaaacacatactttgcagtattggtataatggctaaatgatacgatatatgtactgtaccttaataaggcagttataattttcattcctactttctatattgaaataaaatgtatgcactttagtagacatttctattcccaaagaataccaaactttgtagtttcatttcaatttggccaccatcataatagagacttgtctcagctgaagtctcgtcaaatgccactacttgataatctgcaatgtgacttctagaagtccttagaatattttcaggccctaccagtattttggtattctaggtagactacagtagtattctaggtagtattcctgctaggtacaatgaaatgaaaaacaatcagtttctataactataaatttggtaattttaaaaagctttagtatacaaatatcacattataaaatcaggatgctataaaaattgtttaatccagtagtaccctacattaataaggtgttttaataatatcacataaactttatatagcacttaataaatgccaggtgatgacctaagagctttttatagtataattatgcgtcctaactcatttcatagtcctggccaccctgtggccttagtaccatcatcatctttttttccagagataaaaagatagagatgtaggttaattaaccagccccaaggtcacacagcagtaggtgcagagccaggattcaaacccaggccaactggcattagaatccatgctctaagtcaagggtctgccagtgtttgtttgaaggccagagagtaaatatttcaggctttgtgggctacacgatctctgccacagacaatctgtaacatgtagcttgccaactcctgcttgaaaccattacactcttctgcctcagaaatgctttatatttttcagagtagttttacacgtaactcattcaattctcacaataaccttttctagtaatgacatgttctgttattgcccactggtcagcaagaaaacggaagctcagtgagtatcccccttaaatatccagcagcagagactagagacccacgtgcctggagtccagattgagggatccatacaagaattttttctgatctactttagcaactccctgccgatctccatattcttccctaccaaacaggacacttaggaaacaaatgatcaaagtggaagttatgacacctattttacccctctttgcagtatcgattcattccgtctctttcctgtcctatcagaagaaaggatgtctctgaacatttactgtaaaatttccctacaaaattttaatataaaaacatgttctgaaaaatctcctaggacatgataattcttttaagtctaagaaggaactataagcaaaatatgtaagcttttaaaaaaaaaaggctgttaaagattttacaaagctgaaaaaaatctccactactgtctccatatgaccaacactttcagctaaaagtgtacttttatagcaatctctctcctcttctccttctattgagactcaagttttttttttcaatattgccaaatgcatacactataaaaagtgacttaaaaaattctggcgttagcagagttatgcaaacctggccatttactgtggcccacaacactgcaaaacatgaccagggctctcattacctctgggaacttcttctggaaaaagcgagaaaatgcctaagagccttccacatactagctttatggtaaatggaaatagcaaaagtgttgtaaaaaattacagtgccaataacaatactaagaatgataataataataactgctaatattaactgagggctgattatatgcttggcatcatgctcactatgtattaactcacttgatccccaagtgacccatgagggaagtgctcttaccatcctcatttaataggtgaggaaactgaggcacagaaagcataggtaactcatgggagagaagaaaactgggaagtgacagactcagtgataactacaggctccaaagtctatgttaaccattcttaccattccattagtgaacaacatctggtgtctacttagagcagggcactgtgaaaaatgtaactgatatgtaaagtaactgataacttttatagtatcagtctgaaatctgtttatatgaattggcttcatctcatcagggagctctgtatattcatggagctctccattttacaaagccaagggaatgaagattttaaaaattcagagaagaatgttctgatgttgtcatgtgcaccagatattgcaaacagctatctatggtacagtgaagtggaaaagactagcccatgtaatagaacaggatttctgggtccggttcctggttctgacattttgagcaataatttttataagctgtaacatgtgggcaatagtaatttacctgtgagggttagttttaggggtaaacaagacaatatgagggcactttgtaaactgcaaaaggataaataaatgcaagttgctattttttttattatagccctcctctaaggaattagctttagatataaatttcccccagaggggtaatcctaaccacaaggcaatacaaatacaccaagaaagaaagagtgacagggagagaaaaagaactgccccagtcctgttccactaaacaccctggaacttaaaatatttacttgggtttccccaggggccttattaaactgtgggcaggcagcggccatgactaacaatgggacgagcactcactgcctgctctgcaatccccagtgaccctgccatggctcggctgtggaaacgttagggaagagaaatatgtgacacagggagaggaaagatgggagctaggaaagaaaagatctcagccccactccaccaccgccccaccatccactgctttcaaagcttggtgagagtaatctactccatagggtcaaggccacagtcacgccagggaaggcaaacccatccattagattttatatccctaaaggggagagaccatctccattttacatctccccgaggtgtagttgtttaaacattcggaggagaccttgaccttgaacagaagctcttactggactaacatagcctgctttctcctagtggtagagcaattatctggcaagacactctactttgtggccattgctattgacattagtgtatcttcttgcatatccaatgggaattctacagaattcactaaatagataatagtgatgagatgttgattccttttatgattttccttctaccaaatgaaacatattgaatattgacatttttggtctaaattatatacacattattatcattctgagggattagttcttcacagagtcagttaaaaaggcatttgcatgattctttgttcttaagaaaaaaaagacaaccccacacctagtaacttcttccacacatcattatattttctttctttgcagttatttctggattattatttagcctgggatgtgaaaatatctgatactttacaaaagaaaattaatacctagagttgagaagtaattcctttgaaaaatagaataattttatgataaaaattctatatgcagagtaaaatgagtttcttcaaagaggcaaactgtaacttatgtccagaaagctggctgatcgccctataatttgttagcactgttttaaaaatcatactgatcataacagttcattcactgagacattttatttttttccaatacttcaaggctaacaaattacaaaagggagaaattaattacactagaatataaacagatgtatattaaaagcacacatctcatatgtatcagaaataaaataattaaagcttcgagcaccttttctagaatcctcccattctgatatttcagttgacttttatgccccaaataaaagaagtattactgctggtgattcttctatgacactgatatgggaaaaattaatatttgcataatacatgtaaaagcagaataaaacaaaaacataccaataataagtaatggtgaggtttctctatttatcctcatagaaacattaggtggaagagaaaggaaacaattataatcatttcagaattaaaaaggaggtaggaagaaactaattgataggcaaagagaaatatccatgaagtgtatagggccctcaatttatttaatcctttgattatacctaacaaatatcatgtgccaaatactgtgagatcaacttcactatcagtaataaccctatggattaggcactattttctatactttgcagataggaaaaccgagtcttaaaaaggctatgtaccttggccaaggttaaagtgctactaaatgcccgagccaagatgcaaattcctacaccctgcacatctttggagggacatttactactacgttctgcaacagcagcttctgccagctgggagggagagaggttaccatgctgtctgcctggcagctgtgcatttctctagctgggctctgaacaactcagaaacattcaactcgatctggagctgtgcctcagcaattctcggtaacctgggcattctcacgggttccccacctcttgctctatgcaggacactttgtctaacatatcctgcagagacagatgtagagagttgagcagctttaaaaataatgagtcttggcaaactcttggcttattagcccacacaccagttcacatatgactggaatcctcaaatcagattacctgacaggcaatttcattatcttgctctggtacaccttcagaaccctgagatagccagatacacatcacccattaatctatttggtcagccaacatgcagctttgtaatcctgttcgtgcagctacccatgttcaaccattttttagtgcttttgtgtccactgttatatgccattttgtgtacaggagaagaggaatggagattttatttgtgttacatatttaatttcatcattattttattctacaataattgaggctgaagtcatcaatgtaaagagatttttatcccattacttctcatctagtcatctgaaactgaatgttaaacattctgccatgtagagtaagcactgaccacaacatgggtttaattaacctgtgacagaagaaaggaatgcaaagaatggataatagcttaaagttagatgtaagatatacacattcttctataatcgtagtgtatatagctaatctgattttgctacaactgttcattaaatctcaagccaaaaataatggaaagaaacttctttattaagtagcaacttgctgcaaatctccatttcaagaatatagtaaaaatagcattctttctacttctttctcatctttcacccagaaggctgaaaaagcaggatgagcttcccttagggtgcagagtaaaacatcctggtcctttcaaagcatctctatccaactcaccagctcatactcctcctataaagatcaggcattccatgcaaattgcacgacacagtctacgctgctggacacattcatgatttcccttcttcacaccttgtgcccctccaaaatatacccattctgagcccttatactacttaccgtctatttggtcagtaagtcaaccccattgcctctctttggcacaaaagtatcctaaactgcctttgtggataaacatgctatccccatcaaggctgtccagacctggcactcacagtttcctatccaccttagtctctcccacatcaactagtaaccaggagaactacatttaatccacacttcctatgtgccaggcaccatgtgagctgttatatgtacacattcttacttaatctgcacaagagtcctattagagtttacaaccaccaccaaaaacctgcacaagttatttggcaacaaactgcaaagtaaaactcaaattttctatgcttcaagctggaactctgttctcctacccatcatagtcttcttaataaataaatatctcagcctggtgtggtggctcatgcctgtgatcccagcactttgggaggttgaggcgggtggatcacttgaggtcaggagtttgagaccagcctggacaacatgatgaaaccccgtttctagtaaaaatacaaaaattagctgggcatggtagcgggtacctgtaatcccagctactcaggaggctggcacgggagaatcgcttcaaccggggaggcgggggttgcagtgagtcgagatcgcagcattgcactccagcctgggtgacaggagcaaaattccatctcaaaataaaaataaataaataaataaataaataaataaataaataaaataaaataaataactatctcaaatccagtggtctgcagcaagaggaagtcacctgaacaaatgccctcataaagccaattcattactccatttcacattccactaatgaaaagccacaggaagactttttttttaatctaaattttgatctcattcaggtccctccagcacatcttacctgccctaaatgacccggtatgtggcagactagtcataccaaagttggaatacttaggaagaaattaaacggctgtttgggcccaaaccttaaggctcctgttccaaatccctctcctaaaaccacctacatctccctcatttctcacagcatgtctatcattatatgtcccttttgaactgtaagctacacagggcacagatcgtatctgtggctgtaaacatatttgccttggtccccagcacaatgcctggtacgtgggaggtgcttagcaaacatttgttaaatgagaaggggcgagagagggaagcctggaggtcaggtggcaggcatcctagcttgagtttcagccaggtacgtgggaggtgcttagcaaacatttgttaaatgagaaggggcgagagagggaagcctggaggtcaggtggcaggcatcctagcttgagtttcagccacacgctgcctcaggaaccacgcagcccactggcagagttgagggttgacaggaattccgagactgcggtgcctggggcaatgtggtaaaagctatttttgtttcctcatgtctaaacaatgacatttgtcaatggacatatacagaagtgaattcaatcctggttagtgtgacattcttctacacgctgccggctcttatctgtgtgtgtactatagttctcctctgtacaaaggggatttaaaaagaggctctaatatcagagattttgctcaataactaaaattataagtgacctttttcagagttcctttagagacaaaatagcttgtatatacaaagttttgttaccattacatgtgtttagaagcgtttttacctttgaataatctaaatagttggcctcttataataatgatgtaaataatgaagcagtcaagtggagcggttcacagcatacatttacaatcaaagagacctgggttcagacaatttctcaaaaatattatgcaagataaaacaagcacaaaattgcaatcatatgatagtatctacccccacggtataggtgggaggattaagtaattaaatataaaaggtttagaatagtgcctggcacatggtatatataaatgcttgctgttattattttgcattttaaaaaaagtctgagagggggaggggcattaaaataaacataaacaagaaaaaaaatctgagccccaaagagattacaagacttgcccaagcttacaccgaaatattcgaagttaagcctaaaactcaagttttaacccccactcccggcaactgtactacataatgccacacagattatactgttttttttttgttgtttattttttgtttttaagtaactcgctttttttcctttgccttttgcattttacactgaacaataatttcctagctttcaggaaatagtaatttttaaatgcttaccacctgattatattcattaaagatttccaaaatagtccctagtctagcaaagtagaaatcacaccattattatattattacagagctgaagaaagagaatatatttctcttccaaaacttctatgagagtcaatataattcctattatactttctctgctattttattatccttttctttattagaggtttagatttgaagccactcaagaaaaaggataggaatggaaagagatttaaattgctctttgtccatattaaggccaaagctttagcagataagggcaaagggaaggttaagacacaatggtcaaatgctgtgacctaattacgtctggacttacttattttcttgtcctttcattaatgagaatcatctaatttagactcagttatcatgtaacaataaaagccatatatgtttaaacatatagctttgccttgatgtaattactttctaaatgggaaatatttatggagcagaatcatccaggctgaatcaaaggaaagagaacaaaagaaagttggtttacatgaggtttttgttgtgtttttcttttcttatatatgttctggcacttttatgtttaagccaaaaactggaggcagaaatgaagagaattctacagccagatgggcgcttagatgacagaatggcaagaagggatgtttgagataatcttatgtttcagggaactgacacagtttcgtaaatcactgggatggtgaatggccaggactagggccagatgccctgattccctatgcaactttccttccccctaccctggcccctcccatcaccactgcctctcccaccactcagcacctttgcagccctgctgggtcccattgcctccaaaacccttcttcatggtaacttctgctgtctggggctttattttctgatcattcgttgtgactcttcttcttaaaccatcatttgactctttcatatatatctgtctagcgaaaaatatacatgtatatatatttgcaaccctcttaggatatagtatagcaacaggcccataatgagcactgaatatttactgacaggatgagggaataaatgaattgctcttgatgtttgcagagagcactccctaacagttctctcataatttttcttctccacaatataattcataacgaatgctaactttacattttaccaaagacccaactacatctgtttatgttcatttcactacatacatgaagttttaagtcatatgcacaatcaaaagaatatttatattctctctgaaggaaaatatggtctcaaatataactgtttgaaagtcattcatcacatctctggaagaagtcctcctatagccatcctggtgctaggagtaaaattgctgaaagaaaatagaaatgtaccctactgcaaagataaacattaaaatacacactgatgcctctagaagagcaattatcctttggggagtttatttgctttaaaaaatacttcttgctggatgctttccccccaaatctgaacatatgaatatactttgaaacaaggattgggcatagatattgctttctttaatatgtgttctgaaattgactaaaggaacaggctggctgtggggataatatattcatattggatcctatctcaaacttgttactgtgaaacacttggtattctaagagtattagggtagttatataaaactagatttactctattttctcaaatgctccaacactgaagattcaagcttcttatgctgaaagtttatttttaagagattgcttttacattaaagggctaaagaatgaattactttcaacttcaaattttacataatgcttatcagccaatatacgaagattttcaatttttacttaaaatattgactatgttattaaaagcaacaggccaattaaggcctttgaaataatataaggtacaaaaggagaagaaaagaagaaaaatcacctgattccttaaacaaagtaacaaagtaactagttgacagatgaaatttcctcttctagttaggtattatgtagtctcaaccataaagagcaggtgaatttggctgtgttaaaatctaagtaaaaaataccttgttattcacctttaatattacccacttgtccttctttccattgaactacttgagtcatctcccccgtgccgctgtgaactgtgctcatactttagctggccacaaacgttaagtcaagctcttaaatatccgttctagtttcacatatgctactacctagctgtgtagcaaggacaagtggcttaacgttgtggttatcagattctttatctctcaaaaaggggatggattagacttgggctcctctccttgctcccatccccaactaccctccatatcgtactgcagggacaggccctcatccatcgtaacagcgacttgcttagacaatgcatggagtgaggctccctgagatcagaatcccaaaggtgaggcagagccaggaatggctgcatggaccaagctctaaggatccagaactaagccctatagttctgtaatgtgagcgccacctttacatcaggttctaaagacaatgctcttttttcaaccaacaggcaactactgctgtctatgagacatgagactttatccattaattaactatgtctattaagaacaggtacagcagacagatgctgtataagggatataatccctgttcactatcctaggttccccaaactctacctctttacaggcctgatgagcaaattaagcatacctggacaatttcagtgcacaagacaactgaaacctgcctttcctgctgaaatgccttctaagaattaacaatttaaagccatgattttggtctttacagggtcattagtaagaaatagccataaaatgcaatttataaaattcaaaataaactctgctatgctacctggtaccacttgtgttaagagccatgtgacaagcacctcttagtcattaaataccaggaaaaaagtacacttttttttcttgagatggagtcttgctctatcacccaggctggagtgcaatggcgctatcttggcccactgcaacctccacctcctgggttcaagcaattctcctgcttcagcctcctgagtagctgggattacaggagtgtgccaccatgcccggctaatattttgtatttttagtaaagatggggtttcaccatgttggctaggctggtctcgaactcctgacctcgtgacccgcccacctaaacctcccagagtgctgggattacaggtgtgagccactgcacctggcctgaaaaaaatacactttcatgagaaaattacaactatatgaataaccaggtttccctttccccacagctaacaggagactaaatgccaaatttaatgcttaaacagatagtggacattaagttctccataaaatattctcatctaatacatttctagtttataatttttattccaactgacttttttttaatgtattttttcatttaccactttagacatgcctgaagtaagtgaatatataaatatatacaggccaggacagtgtcacagggaaacgtaaggaaccgaatgcagtgttgactacacagcctcctccccactgggggatgggacgcaccctgccacccttggcagttgaggtcaggctgaccatgaggaaagaaacggtcatgtggattcaactgctgaattcaactaaccacaccagcacttcaacccaactatattcattcatctaggagtttctttgagctcagcaatgttgtttcttgatcctttgacaaaattaatgatgtagcaattcattactgacagggcaaaaaattttgccacaatgtttacaagctctaataaattatggataatttaccaaattaataccagtgaagtgaagcccgcctttttagattttcatttatcattctacctagctctttcctcccctccgcccatcgtctgtctctctctccatctctctctctctcacatacaagcagatagcgtcatttttaagcttatattttttctaaatcagcattctaggtcactttttgtgaaatgaagttgaaagtatttattaggttgcttgcacccacagcaacagtatttctgtaacagattttgacttgagaatcaaagtttgaatatagtataattggtatgttctagcttggtcccatggcccattaaaaaaaactagaattagacataaagtaatgaaggatcctataaaagaagctgagcatcattttttaaaaaagttcctaatatgtagtaaactcaccattgtgaatatcaaactgtgttgagtacctactgtgcagaagacagactcctccatcaagaaatttttaaatctagtgcaaaaaataaaatagaaaagagagcttccttttatacatttaatatttgggtttggaaacaatatattggtgtatgagcttataaagccaaattattcttagcatccagataatttcttgtggcaataatgggaacttttatttataatgtaatatttatattggaacagccagcattaaattactgagctgtttgtgttataaaatacacaaaaaggaaaggcctcattttcagaggattcacaaaccaacatgaaagtcagtggggtacaaaagtaatcacccaccagctctgcaacccttatgatgaccatgagagggatgcatgggttttctcaaagccatacccaattctaggggaagaaaactcattaaataactcctttgcaaagagcagggcttagttaatagtccatgctctttaaggaccaaacctttaaagagagatcactcttatttgctatttttgaataattccacactaacagcttatctccagctggctatcttcggttacatctgactttccccaagcaccccactttcctgccccatcattaaaacctgggagtcatctcaccacctgctccttttgtgttccctcctgtggtcagatgctttctttctcttccaagttcttgggacacctactttctttttattttatttttaaaagttattattattattattgtcattattttaagacagggcctcattcttttgcctgagctggagtactgaggctctatcatagctcactgcagcctccacctcctaggctcaaatgttccttctgcctcagcctcctaagtagctgggacaacaggtgtgagccactatgtctggctaattttcattttttgtagaaatggggtctcactatgctttctaggcttaggctggcctccagctcccggccacaagtgatcctcccacctcagcctcccaaagtgctgggataacaggcatgagccactgcacccggccatgctttcttttcctttccttgagtctccttgtatctaaatttacatccctcttgcttgcactgtggcagcagactcctaactgggctttcggtctccagtctcacctgaccttaagattattctttctaaagtgcaattctcaattctttgcagtcttgttcgcaagtcatcagaaccctccctctaccttcctggtacaaacaacttctcagtttatcatttgagaacctcctccttgggactactatttgcctccatcaggttccctccctcagtcaaagtggtctcaactactgtgctctacaaggattacgcctgctattttcctcctcagcctgcagaggggatgggcaggggctgggcaggagctagggaggctgtggggttggggagggacactctgcaggcctgttgcttcccaccctccagcagctgggtctatttacccaagtgtccagcataaatcattttctggaatatgctccaggcaaagtggcttgacaaattactgttaaaggcagaacttcttgtctctgtcttggctcctagccttccctccattctgcattttcaaaatcctgccatttcacacccttctctcctaagaaatccttcctgaccttcccgccaacatggggcttcctctttcacacatatacagcatttggtatgtgcttgatggtattagttgtatttgccctgcaattagcggatgatactctaattgtcctgtgtctgttattaggatgtaaaaggtattgtattccccaaaagcacctaactcataatacaggtacccaacaaatgtttgtcaagtgccaagatattgaagaagaaatggctgaaaccacagttggaatactttattttgtttttgtttgggtttttgttttttttttttttttttttgatcctaacagccccatctgtaatgacctgggcaggtccctgcagggcttcttacctgatccttgtcctcttctagttttctcaagggtcctttttcagatttaaaattattaatttgttaaggatacatggtaataaatgtcaaacattaaattatatcactgtctgatctaagaagtctttaactagctgaatgggttccataaattctgactctaagaactgaacataaagagttccaacttttcattcttagtaatcttaccacataccctcagcgtgtgtgcttggccagtaagtaagttgtatgtgaccttttcagggatttgtgctaaaagatggaaaactggaactattctagcaaacgtgaagaccaataatatgatatcattccaaaataaagccataaagaaagtccacgctggaactaattggcaccaaccaggaagtgtgatacaatactctcctttccactgaaaaaccttctgtggtttcagggtgaggatgaagagaatgaagaaaaacaaacacaatatgaaattcaaaccacaccaggaacaaaaaaaatatgcgctgaaagaccacagagtagcatttttatgggtaactttcaattttatcaagatagagttaggaaaatagtacgcatagctatgctatgtgacctaaatgccaagttttcattttgttttatattaatattagggcttctcatatttcatctctgtttatgtttacataaattacattatatcaaatccagatttgaagcatctcggaataaatacttgagtagttcttgctaatattttcatagttcaacttttatttttaatgttagtctgggaaataatgtttgtgtgtataaatttaattcaatcacattactatgctcctacattatgttttcatcatttgcacaacaaagtttgctgtttatctaatatatatacatatgttttatgtccatctagaaatatgtattttcctgttttataacagccaaataatgctaggtatatatattaaacacaaaagcctgcaagaaaactttttcctttataatattcatatttacgtgttaagggggcataaattatttttaacttatatggttaaatgattaaagttctataaatcacaaaatagctgagtgaaaacagaaaaataagagctgagtcaatctattttccactgttaggaagaagatggaggagaaaaagttaattttacatgacgctgcataattttactttagctgctgcttcattcagtgactaaacacattgttttggaatatccttttgtcatatgtacagaagggctttgctattgtccctcaggaaggctggcagctggccctgcactttgacccccaaccctgtctcagcaaggggctcattgatattcccagaagattctctcaatggaagaagatcatttaaaaaagaaaaactccaccttatgggctggtggtcccctcgctcctaccctctgctcctgcccccctctaagtgatggcacgcaggaccggtcaagcccaacaatccctgggccttcataaactcactatttttcatgtatatttgatgggtcctttccctcttattcaaagcagctttcacagtcatgttactgggtgagagccttctattctggacttacatttgattaatttgtggcattcatgtgtctaattttctacacacaaagggaatgaactagcttggactctatcgacgagtcatttttgccaggaaagttcaaacgtaaaggaaaaggctgtgtcagtggagatggtttccagctcgcttaaaaggagcttagaataaaacagtctgcttaaaaaataaaacacaaaacacagccatcatttccaatgcttttcttaatgatattttaaaacacgtaagcaaatacctaaatgctgcattccttgtcatgcatacatagatcttcacaagagggagcacccaaaattactgcagcttcacagacatcacacacttaaaaaaagactcctggcttcctttcaaattccatcagtcaacttttatcaaccataggggaagcagaggaggataaacactgcctgcgataccatttgggttttaggttttgggtttcttccagttaagtttgcaaaagtgtgaaagtactaaagaacagaatattgttcctcattcttactatacaataaatacttccaaatatgtccttaaatgcaatcctttgtgattcccttaattaatcttgactaatccttgaaggaaccatgatagcaaaaatttagtgtctagcataaccttactacagtttccctttttaagttctcatttgaatttgataagttaatatttactttaaaaaaatccacatcatttctattcaatggcacttgaacttttaaaaaatgtttcaaagaaattaaagctagatatgattggaaataagcaaaacgagaaagagttgtcctatgtgtatgtagcacaaccctccctgtgtcctttaataaaaagcaggactctggtcattccatgatgtcactggcattccgcaccaaaaaaaaaggtccccacagatcaaattccacttcctttcaataaagctaaagatgaaataaatctttaaaatgcagggggaagagaaaaatgtatataagttcttccagaaaatctgagagggcttgcaaggaataaggcacagaatcaacaaccctggcttccagttttgctgacttacttcaatgaccttgggcttacccttgtactagaggcagaatgtgtgtgggcacatgtacctgtgcatactttcaagctctggggcccgaaaaagtcatttatgtactctggagaggtgagagaataccatgacagacaaatgaagtttgagacacaggatcccatccacccacccctgccccaggttgggatgtccgaaactaagacacccaagactcccaagaaagggaagacaaaaggcagacattcatacacagggctctagcagcagcattctctcacaagagtagcaggaccattaactttataaaaacaatagccaggttccctgaaggctgcagatagggaaaacctaggtggaggtctatatgcatttctaggatatgccaagaaattaaggggtgtggcactgggcactggacatgtgaggcaaagtagcgagtggctgggaatgaagaatgtgtttctaatatttacattcaagttcttttttgttattgttgtttattttattttcttacagtcagggtctcactgtcacccaggctgaagtacaatggctagctagatcatggctcactgcagcctcgacctcctgggctcagatgatcttcccacctcagcttcccaagtagctgggactacaggcacatgccaccatgcccagctcgttttaattttttttgtagggatggggtcttgctgtgttgcccaggctgatctcaaactcctaggctcaagtgatcctcccacctcagcctccaaaagtgctgagattacaagtgtgagccactgtgcctggcctatattcaagctttatacaaacacacatatacccctctgcatatacacatatataccccgtagctatcaaaatacagacccatttttctacaggggaggggaagaaaaaaaggagaaaagacaaagaggaataataaagatcgtggggagagaacaacccatgggaaagccagaaaagagaattgagagacagttagaccagggagaagcctggcaattcctacagagaggacatgcctaggcaggtagtggaggggaagcaatggtgaaatcaggccagcagcagcactgcattaacacttgagtgatcaaacaaagggtaaagccatcaggaaagaaactgacagctgcagtccttaaatgccccaatttagagacacaatgactccttcttccattggccatcctcaaacccaagtcaggaacatgcagtgaggctagacatagacatagactttctagacagagaacatacaaataattgtggaacataacagaatcagaaatgccaacataaataaaacttcagaatttgtagggtttgagccttgtgatgaaatcaactagttgaaaaaacattttttaaaaaatttgatacagaatatcttatatataaaatatacaaaacctcagttttataaaattatcataagccctccatacttttacaaatccttctcggtcttcagattcagaaatggtgtatctataataggaactaattctgaaagcacttaaaaagaacaatgtcaggacagctaaatatatgacttataaaaatcactagttcctcccaccttggttctgttgaccttagtggccaagtccttttcctgagcttttaataaacacatgcctgtaagcaaagatacgcatagttaaatctatacttagcatattaacccccagatgagcataaagacatatgctaccagagatccaggaaacaagaatctgggttttggggctttctgtattgggggtgaatgttcaccttcccacaagagtctcacaatggtggctttcccagccctctaggaaggggcttcctcaaaaaaagtagcatctccaaacactcatacattgtgaagcaactcaaatttccaagtaaaaagatattaaatgtattaatagaaaggactgcagactacccttaaaatatatatacgtgtatatatatatatatttttatgtatatgtgtgtatatatatatatatttatgtatatgtgtgtatatatatatttatatatgtgtgtgtatatatatttatatatatgtgtatatatatttatatatatgtgtatatatatttatatatgtgtgtatatatatttatatatatatgtgtgtatatatatatttatatatatatatatatatatatatatatatatatattcccagctctttgggaggctgaggtggaaggatcacctaggtcaggagttcatgaccagcctggccaacatggtaaaaccccatctctactaaaaatacaaaaaaattagccaggcatggtggcatgtgcctgtaatcccagctacttgggaggctgaggcaggagaatcacttgaacctgggagggggaggctgcagttagccaagattgcaccatgccactccagcctgggagaccaaaaaaaaaaaaaaaaaagcaaacaaacaacacaagaggaaatgatcttctacaaaaggacagtgaactattaaaattccacttcctaagcaagtgtacaccactttttattttgaattaaaatatcagaagatcactgacagggaaaaaaaagtaggccagaattatctggattactgccctaactctagaaagctgacatagcatgaccaagacctacttaaaagctggctgtatctgtttaacaccaaactctgaggagagacctacctcctaatggtgaaagaaactgttttcacattttgagaggcaagacccataaaggaagggcctctaatttccagtaattaccctggtaccttaaagtccgtaattacatagagaaccatgccctgaactggccttcagttggttccaaacccattgcatgtaattagccttgattaatatcccacatttcacatcaacagacacagtgaatccaaatgattcccacgttctgctgcctccggaaacctcactgttcaaattctgtgcctttatcaagggaacatgctgagcaaatgggatcaaatgatgccttggcacccaccttggtctaactattcagagggaagtagcaatgcctttcatgtaatcatcttaatcccttgtatcaactaattaatacacagagaaagcttttacttgcatgtgagcaattatagcaacttcctggtcggtgtccaaatggattcacaatataattcatgaacaatgaggctctgggaaagacagctcctagagatgacttttaaaatgaaaaagtgtgtgtgtgggggtgggggcgggcaggtattaatgattctaatagtagaaaaagaggacagcaagtaaatctcagtttctgaaaaaaaattaatgttggaaccctattgtgcacatgactggcttaaacagaccaattgatgtgagcaaagtaagaaccaataaataccagagtttggattctatatccgtatatacctgaaataccaccaagttacttccaagggacttgaaaacaaacctgctgccattaaataatgggcttctgctaaaaacaaacgaaagtaaactcactctacacagacttctgaaagccatctaagatttgagctcagtgatttcacattcctccctggggggtacctgttgcagttgcacgggtgcactctctcttctctctctctctcaacaggaagtagcacatcagtattttcagctgcctgagaactaatccaagaatggggcccagggcggcaagggttgggaactgtgagcgagtgggggaagagggcttaggggcctacagaaaaagatatccgaagcatcagcacctgctgtggggtttctgctcccgtgtccgccccagccagagtgggaattgctccagcactggggcaacttgtaatccaacctggggcagagagcacaggaacctagtggctcaggcgttcaagaaaaggctcccagtcataaagcaccacattgtggtaacaagccccggggttgcactgtgaacttttcctgtgcagatggctcgctgtcggggaaaaacattacccagcaaagtccagtcaacaagttcactgaatccaagtttcaaaaaacaaaacgcttcctcaatcaccccctcgtgccagactatgctgaagctgcttataaattaccaagggtcatcctctttttttttttttaaagaataaaatgctaatggcataggtttgggctctctgaattaaatactgtactgagccaccctgggaaccagacactatcctctggctagaaggctaaagaatgagcaattgccagccgtggaattttcatgatccagtttccccaccttcctgtcgcatacccactggcaggaaccaaagggctgtcaccctgacgagagaaaacaaagctctgcactgcgttatgaaacaggtttttcctttctcgtagagacactcctttatggcgaggtcatgtaaaacagcaaaatgctcaatgaacacacttggtcctgttccctgcaggtgaccgtacccttcaacttgacctgtgatacagggagagggaaagaaaaccactctccaatttctaagtaaaaggtgaccagacggcagggatggcaaagcagagcctactgttaacaacaaaaagaaactgcaaacagcagcgtggacagacagtcatacaggtgtgggccgggaccttagagggcaaaataaaatgcttctggagtctaatcttgagccaaattgactaaaaaggacagcccggcagagaacgtgcgtgatgtgagttactctggcaccgagaaacctgttcttatctggcaagtacgccccctgctggccgcggtgctgaactccgcctcttggtcctgcgccagacagccctcggagctctctggtttagaccgggggaaggagaaaggagctctggcagagcgagtcccttgtaaagcacacaatgggagcaaagggtgccgtcacagcagtcaccgccccaaaccacaatctttgtccagtcacggttctctgcagtcagataaaatccaagcaagctgaaaagaatgaatacaaacctgcttgctgctttgcaagtgagaagtttagaaagctagggaggagggggccgccaaagggaacctgccatgaaaagattcttaagtcattcacagatacagtgcttgactactggagaaaatctggactaactgcccttttagaagttagagtttactataacgttaacagtaattatttaaattattagcacatggacactgcagcgtaggatcaaaatgcattcaaacaacgggatggaatttattgccaacaaaatataatactaaaatcagttttgcacttccattgtttttttacacatgtcttcacacggacattttcatgtttcttcccaagcttttgccttccttttcacctaattctttgtcatttttgttgctgttggggtcttgcataagcatgctgatgttttgtaagatcagcccgctgtcccttatgatgattcccttcagaattggtgcattcaatgtctttggcagaaaatcctatgtaatactggcttgtgtgttaagctcattcccatcatcatcaattggagacgcttacttaaggaaaactgccaagacgttcagctaggcgccatccgttaagacaaccaaaaagaaacctgtttgtaaaggcgcagtgggtctttcccttactggcacaaatgtcataagtgagtatctttagttcacattatctgcccttagtctcagtgagttcaccagctcaggctgaacttggcttctccctgggacctcaatctcatgtctgttcccagctctcaacttcaaacacagaggacagagaaggcaaggcatctaggcgtgagcagagaaatataatgggcaaaagaaacatgcttcatctcctttgggtcagtgggtctggttttcattttctggtttacatatgaaaccagggggtaagaagtgccagtggaatataggccccaaggacaaatgctctcatttcagaatttaaaagaattttccaaagctagatatctcagtgcttctttacttaatcctgttggccgtaatttttaggttttgtttcttcatgctccttatgcaagcagaagactgtccaggtaaaatgagagtttgtagtcattcttttatttatttgttcaagaaatatttattcagtgttagacctgttttgccaaaatatcctatgtggatagtacagaatacaacagcggcttttattcaccacttcttttagcttgcactatggatgtctatcccagggaataacatgattacgtgggtttccatgctatggtttagagagttcaacccttacctatcaaaaggtctgggaatgagtgtgtgggtctatttttatttataagagggggagaacggaacagttttagaacgaacaaaatcaatctgcaccagttttgggaataagcttctgctgtgaatagagctgtcaagacatttgcaatctgtttggccctgtgtccacaagaggctaaaggtttcataaccaaaaagtaaggatttttattctttaccacttggctagcaggagcctcataagacttggggtgattttagctgttctattacaccctaaagcaccaaaatgcacatctatatttatactcacatgcacatatgtgcaaaataatctgtaagaaaaacagaatcttaggctcactactattttatttcaagtatggggataagtatgataactatcaattggttttcttattgaatttaagacgtattcatactttcttcaataaagtcagatggaaaagagttatttggaagaactcagaggatttttactcatggcttcaaacatcactaaatggtggaaagtgggagtacaaggaagacttttatgaatcaaatggttgattttcgggagtactcagtgtctttctctcatattgtaacaatactaggagccctcccttgcaaaaaaaaaatcattcaataagctctgactgataccaaaccccctcagattaaactcaatatgccattaatatgaaaagaatttgacagtttacataagggatgtgacctggtgccaacaacctctggcttctccattctccagatggtagcagattagtaggcagcctttattctcataagaagatttttttccccccatggaaaaactataaaggccaattctgttccaaacttcaagtttccttcacaaatgtctacacaattctgggccttaactaatgctattaaaagaagcccctgggcttgaagctatatggaaggggggaaaaagactaaggcaaacttaactctaatgcctgtctttaaaagatctattgacagaagcagtggggagagtttgaactaatgttaacttaaagaaaaaggctggtgagattcaattgtggatgtgaatgcttgcttgagtttgatcttgacggggcttaagataagggagataaaaacctaagcctacttacatattaaaaaatgcagttgcactaaattcactacataccactgttctcaatttgatttatgcccatcatcagtgaagatgctgaaggacacccctgtctaatatgggaagaagccacagcagagggcacttgctctgctttgctgatgctaacgtgaaaaaccatttcctgacaatgcacgatactcgttctttcacattaactcttcaaacgtaacaaagaataaaaacggaatttttctttggtcctgttctgaggtataaatataacaagcagttaatcaaagagatccaagaggtgaaaagcagcctttagtctgtaagaaattattccaccaacagataagaagtgatctttaagtaatcaggaaaaatatcatattttgtaaacagactgaccttagtaacacttttaaggatcttcaggtgcactttaaatccagaaagctaagcagacactttcccaaaatgtttgggttgttttgtggtcatcaggacacataccatgtatcccaaaggagaaaattatgtcctctgaggggaaaaaccttttctagtaatcctttgaacccaccaagactgcttttcataccaattagttcataaaatgtgttagagatacttttcatgcagttttaaatgtttttattaacattttctcaagttggtgaaaatgtggtagatgtagcttggatttttttttccaggcaagttagtcatgatgactgagatcctgaaaactataaaataatctattgtagacctactgagctcaatgaaaacaagtagcacagcacatagtccttacccttgaggagtttacattccactatgagaattgggccacagaatgaaaagatttggtaaaaattcaaggtatcagggagaaagagattataaagaaaaaagacagcatctaggattccacctatttaacatgacctatttctagcagtttccaaaatcatttagttaagagaacatcagcatttgccaatagcaaatatacttagaggtcccaagaaataaaagttttcatggaaatctcaaaggcaataaaaaggaaaggcaggatttatttaatttcttttctgcaaactgcctcatttcctaaaggaggaaatgccaggcaaacagtaacttaaatggttgtattaaacactcacccaaggatgccattaatgataactgtccagaacttgtttaagctaaatgtctagttctccaaatgcatcggcagggtacaaaatgggttgttgtaaatggatgttttctagttttctgcttttcctacagtgttctcacagaaacaaccatttccatcatcattatcatactctttttaagtgagaaaagttacatccagtagaggaactatccccaatccagtaactgggaccatcacggcaatcacataacaagtttaggaaacggcttaaggaaatgagctaataacatgactgcacacaagcagattatctctgattgctacaaagaatgctattagggggcaccatgtttccaagtgatcatttttccagcctgttacagaaaggttaatctgccgtcctattcataaaatcaatttagaatcttgccaaatgcaaaagaattacatgaaaaaaatccatcatcaggaactatgccgacatttctttcaattgtcttagacaagactaattcagatattttcctgaccataaatttacccatggaaataaaggctgtatacatgactttatcaattaccactgcttatccagcatgttggagcagactcatgtgagaggaaaacacaatggctgtttataaaggttcttataaagctgctaacacccaaattatttactacatgagaatgagggaacacatcagagaagcttgccatactgttatttaactgcaaaaatactaagcctcctccctttagaatctcagaacaactgctgaagttgtacaatactaaggtgtgatgaaatcccttctctaatccacattctgacagtcaaattgttgcacatataaacccctccaccccatgaaggttagcattccagggttatttccagtcccaaaacatggaaatctgtttcaacttgcccacctatctcagctttagtcagagaattttgcctaaatcttaagtatctatatttcactcttagtttagaaagatctagtggccaactacaccagtttttcgcccttgccttgcagcagatcagattgtgaaatgtaaatcagaatacctttcacctgcaaaatgactaacataattgccaacacaaatttcctcaggccctgagggggttttcagaggcactttggccacctggtcactctgaaacaagtcaattgtgaacataaaactcaaatcttgcttgggaacgtagcctgggaaaaggggaaatttgccattcccagatgaagtcagtttctcggttgggctgttttgtctgtgaatagcatttcatagtttctgtgaaatctaaatttcagatattactgtaggctaaaacaaaaaggaagagctgtgtgccctttcagacacagaaaacccagtgaaggttcagcaataagggttaagatgcaaaaggcaggccgaaacgggaaatttaaggataccccactccagatggattacatccaaggcccacttatctgaaatggaattagaccaaatgtcaagaggaaagaatggccaggcttaccccttcgtgttttgggaagagctagtctgaatgttttgctgacatttgaagtataaaagggtcttattgtaaactctggacccccagaaggcctgcttctagagaactgtgaaaggagagattagttgggggagcctcaccatcggattccacccttcaatcacgttagacacagagctttagccacttctttgcttaaagtcatgcatgtggtcaaaagtttaattatatcaccggctgcatcagcaagcatattgtctgccatccacaggagggataaaccttttttggagcgcgggggttcagacattgctgtggaagacttcctgaaatcttaggttatgcctgacagttggcatttttttccttaactgatcaaagaacatagcctgggtcctgataagattataaaagatttctctcgaattctcaacttttggtgaggcctctactctctcgccaaacagctgagtttttaatggattgtgtctcaagacaatcaaattggcacctttgacataactgactggttctttgccagccagtcattcctccattcaatcaacaagaatttattaaatgcttaggtgctgagaagatgcaaaagtgtgcctctcctagagaagtctgcaatctaagcaaagcaccacgtaattaaactagctatgagtcaatccaactggttatgcatgtataccaggccaaaatccatgaagtctgaggtaactacaaatttcattttggaaattgagaaatgttgatgataatcagttttgggttgtggatttcaggggtggtttcgggcaaggagtaactgccctggacaccaacccagagagtcccaagagggggccacacgaggccaaaaccagttcccagttctaatcagtagaggaaaaaaagtgagaaatttctagaccttttaaatacataactttcagtttgaatctgagtgttctaaaaattgtaatatatgtaaaagaataccagaaaaaataaatgataaatggcctacctcagacttatcaggcaagaggcacccttataagcatccactgttcagagcatctgtccaattaatactgatggtgacagacttttgttctccccaaacacacacactcatacccatgtacatttgccaagcagaattctttttgcagtaaaaaggacatgatggcaacatgattcgcaaaaggaaatgacactgctgtctgaaattaaaagggagcctgcgatgatatggggctggcttctacgctggacatggtaggcccagtgcctaagaccccagcagtgttttaatttcttttaaaataaataaaatccagccttgatcacatttgtatttacaccaacacagtcataagacaaaattttaatttttttaatggaggaaaggacccataaagacaaaagtgcataaatggtgtccacatgaagcacactgtggccctgatcaactctgccacttcctgcttgcccactgcatgccttgaactctacataccctctctactcttcccaacaaccctggaagttaagcattaacactgtccttattttatacagaaggacattatagtgcaaaaagctttggtaatcatgatgcagaagaaagaccatagattttggacacaaacacagctggattagaattccggctcatccattaaccaactgtgtgacatggagccaggttcaactttccagagctaagagaatgaagtaaaatatatacaaagagctagtacagaataagcaaaaaatagtggccattactgtaatcattactactgtttgaacggctagtggctgaaccagcattctaactcaggtctgctgctgaagtcttttctttatccacagtgtttctctttagaactgcatgacagacaagaggctccaagaaacatatagttgtgtgacccagtcttaaaaagaaaaaagaaaaaaaaaagaccacccttgaataaaatcattccataccagaataataataataataaaagccacagttaatagtattatagtccttttctctctctctgtctgaataatagaaatgagcaacatgacttgataatttcagttcaaaaaaagcacagggtgaattcatcatttagttgaaatgttttcatccaccaaagaggctgcaccccaaattcacttccagcagaacttcaatatgccccaccttgctgcacgagtggcacttctgacctttgcatccttcagagatttcactttttagccaaaagatctctttctagttctttgcaatattttaactatataacaaagagacagatgtttaatcaactacaactcagaatatttataataaaactctttatccataaatctcttaacagtttacagtcatccatagcatttcctggactttcaaggctgattttatatgctttgggtgagaatttcaaccataattcagcccctcagaaaggtctattagtggactatataatcacacttttaagggtgcttgacaagtctatatagctgcacacaaattacattttaaagagttcttttcagtgaccaactgccagtgcaattgaagatacttaatattaaaagttaaatatctgacaagaccttatgaacactgaagaatgttccatttagagaacatttttataatatacagaattctacacctacatttaaaaattaggaacatttgcatgagaacagggtctatattttaatcaactcattttctccagctatttatttcctctcacaaggatcttcttctcttcatgatcatctgaaattatgataaattagggtgagcaactgcacagcacaatacttacaccctttcacaggaaaaaaaagaaaaacctgtaatcccagcactttgggaggcccaggcaggcagatcatgaggtcaggagatcgagaccatcctggctaacacggtgaaaccctgtctctactaaaaatacaaaaattagccgggcatggtggcgggagcctgtagtcccagctactcaggaggctaaggcaggagaatggcgtgaactcgggaggcggagcttgcagtgagccgagatgcgccactacactccagcctgggcaaaagagcaagactccatctcaaaaaaaaaaaaaaaaaaagaaaagaaaagaaaagaaaaaagaaaaacaaccacaaacaccacagaaaaataagcatgcgcccacattgtgttgtaccactccattagctgtgtccacacaaaagtgtggctgttttggtcaatttgttgttctccaaattgtagaaatcatggattttaaaatcagcatgttccaaaaaaacgagcttagagaatttcctgatctcagcattgagccagtacgttgagaatatgtttttttaccgtaaatttgtgctttggatgaaactggaagaagactttgaacaagaaatttttaagatgtgtgtgtacaaaatatatggttgtagcaagacctcattaaagttgagcaattcaggctgtgaacaacattgccagccaggctgtttaattcagatctagttccctcctccccagcatgctcatctgccaaaactgcattaataacttccagaaacatcgcatttttcaccttggaacaaactaatacaggttaaactgtttcataaacacagtactgaaagagacctcagaaataatttagtctacctctttccccacttgctaaactttcattccctttgtgatatgatcctgagagattattcattatcatggtcctttaccccggagacatgaaggaataacaaagagcaacagagacacgctgtgcctttagggatgttaacagccaaaaatagtgaaaaattccactagtctacagcacatcgaatatctgattaagctgcaggccagaattatacttcagtttcaatgaaaagtgtttaaaatcagttccaaagccatctacactagtgaccaagtgctgctagagccttcaccgccaggcccaaggctgggattgaatttccccagacagttcactactgcagacaataacagttgccacattcaagtttcatatgttataacaccctgtgatttagactcaagttccacttgtacagctgcctgcttagtgtgtaaatgggaacagggagtagaatctaggtccccagcccaaggaaaacagatccttttatatcttaagagacaaactggctgtcctgaagcctcatgagaacccaaaactcctatatcattttagcagcaaaaacatctctgctcaatattcagaagattttagctacacgttgcaggttcttcttatatgaccaacatcaaatgcaaagaagtaaaagaaaatcagagacagaaagcacctcaaacttctatctctacaaagaaagggagaaaatgaactgctttgcataggtacccagaaaaatcctggtgcctaaagtcttattctaagtacacaggtatcaatcagtcgtatataagtgaaagatgagtgtaacaaaaaagagactgaagacttttacaaaaataaattgttagtaactctaatagagagataaaatattacttataagtccatttttacttcaactagtatagtgtcaaatgtttttgatatgctaaagcatctaccaagtaccagactggaatataacaggtactcaaaaaatatgggtagaatgaacagatatttttaaactacttgtattcatgaattgttccacatatctacataggaaattaagttcatttggggctgagatgatgctttgttcactttagcaaatgtaagacaggatactacaaatagtaagtgattcaataaatgtttagagaacacaatatggacctcctgaagatgctaaagacctgtaaattaccatctttagtcagtttaggaagctaaacaagaaatgtggtattgctcaatttaggcgatcagagaccactttccactgaattctgctacaggccccagaatggaatattttggaacataaaagtgactcctccattactgtccaaatgatattccttcaagctaatgtttaaatgttatttttattttcatcaagccccaaaagtaaatgatttaaagtaaaactaaacataatttctaaggaatttatgaagatcttgtacaaaaaaaaaaaagtaaaaataaatgacctcactctcttttttccctttttctgttcctttcctcttctactctcaccagattaatgtcaataatcccacattccatttcaaacaacagatgaatagatagaagattagcttttcacagaaacagctgtaaataactataatctagttagtaggattcctttatggcttgaagggttataacaacaggagtcctaaatttccctgatcaaaaactttaattccctcctatagggaaacaacaggacatcttctaaagttcaacaacaaggtcatgtatacaacatttatatatatgaactaatcataaagaaccagggtaaagaattttaatcctataaaatttaggtatacaaagatccaaggatctcataactaaatattttctaacaaaaagtgagaggaaaggtagcttaacatcaatcagttctcaatgtcctaagagtgactttctctccctaaaaaatagagcatcctaagagaatgtccaaataagtctggctaaatttaaaacaactcaaagtgaagtaggaataatttattcaacaaaatattctggttcagactgaagtacctggaaaaagaaaatatgaaaatatcaggtttaatggcatagtaataatttggatataaaaatattaattgtgcactactatttactgagcgtcggcaaggcaacagaaatacaatgggcacaatttccctactctttaatgtgaacttgcttttccagacatcttcccaatgaatgagtttttacagaaatgcttcttgcttggtaagaagcaagagagcagtctgaagaactgggcccatccctttggagcatctgcgtgggttacactatggctagggagcaaagacagagtggacacaaggtagaaaaaggatctacataatgggacgtcagcactgttagggaaaattggtttatacctcagtagacagacatgaaaactgcttacttataacaagtactttatatggaattagacagctcttacccattagttcgatcaatcttttatttgatcatttcatgaggcacagacaaactgaatattttcattctctttaccaccaactgtggaagacacccagagccaaccagacatcacagacataggccaaatccaggtaggttttctggtgaccacagacctgcacacttaatctacacctcagagcaaagataagggccataatgctagttcatagttccagaagaatccactgtggatccacacaggctcggcgtccacaggggattatgtatctctagggaaaggtcacatgtaaacattcccaaaggttctaattagctctaggggatatcactgaggtccaggctactctgggaatatcaagattttccccacaggaccaatcagaatccccttaggaaatctacaaaacagaactttgtcctcaagagatcgatgagttgggcaataaaccaagaccactgcttgagttattctctgaggcaacatcaaactttcatggtgactgggatccagtattggccatatttgcctaaaccaacggcctctaaacgccaaggaggcaaactcactgaagatgaaccccattttgatgtccacacagccccaaattcagtcctttcagaaaaaggagtatagccaaggcacagtccaggtagctggctgcagcatttcccctgagatttatatattccctaaatttattatttaagcataaataacctttaaattcaatagttggacatttctctctcaaatattattttggatagtcattgccttcagaatcttgccagtctgtcttctgttgtgcaaaactcaaccattaagaaatttaatgggcacaattaatgtctctgatttgttttccttcccaggtgacagcatttactgatagttactgctgatgagcaacttgctatcaacttttatagttgctcctgcttgctagccatgggactttgtgtgaatttctagtatatagtaggcactcaataagtgtttgtggaacaaatgaacgaatgaacccagctgctgctaaaatactatgaggctccatataaagaatgtaagaggtttgacccattgcaggcactcagtaattgaggcaagggcagaagtggcggtgatggtggacaaggtaatcagagtggtcacaacgtagcaagtcttcttctggttattctaatgtagggaaaacaagcacatcaaatggaaaatattccctggtcagtagggaaagtcaattgctgatattatgggactagtgaggatcatgattacagatgggcagtccccatgggctacaaatggtatggaaatctaccctgggaataaatcccttccattcctgcaatggatggggataaaagtggaataggatttgaagaacacagtttcatgcaatatcaatggcaataagtaggtacaattttctgcttttcacttatcataagagttactggatggaaattctaagttaacttctagaaaataccaagcccaaggaccctctcataggcacccagcagctggcttattcctattgcactacatcaagggcacaaaggagtttttccttataccctaaatttctttccatttctgatggcagcaacagccaattcaaggcaagcaggaaagcagtttggggatctggaaagataaattcttctaaaagagggaatgatagctcagtgacagtactgataaattctaaacaatattaggccatatagagaaatagaaaaacctgtgaatagcacccatttcttatctaaaaagcacaaataagggaagagttttcagaaggaatctggatgagccaaattattaggccagatactacacccactatccaacaggtgaaggtaactacaagaaaaggggatggtagggtagggattttattgaattagtaaatcctttaaaatcaagtcaatccccaaatatggaaaagataattctctttccatgagagaagttgaagtggtgccataacagaaattagccctaaatgtttcagaactgtggttagaagttaagttacataagaacatctggatggcaatcaatcagtggaagatattatatggtataaagtaaaattacattttggggacagtttagttcactggtatgtttaatgctgctttggatagcacagtgagtaaaactgctgaaatgaagactactatgaaaagcagatcactcaaagagaaaaatcagactgacatcaaaatccccatcaaactaaagctagagtggatgcaatttttttaatgacttatcttgccactggtctgaaaaatattgtttatcgtgttttcctttgtttctgaattctttggtcaactcatgggattgctcgaattcagttatttttgttgtattcaatcatgctcaattaagaataaagcctgcctaagtaaaactcatgaagtaaagatctacaattacaataattgcagtaatggtttttaaagataccgcatatctagatctcaggaaaagtaagctggtcttttctataaaaaactagaccaaagaaagaaaaagatggtaaacaaatctccatccctaactagggctattgagtacacaactgaaatagccaacctcataaattcacctttataaagaacagctaaaagcatgagattgagggaggacgtagaactatgaacagagggtaaaaatgtaggacaagtctcttccatgcatctggacccaagaaaatggaccctgtgctactgtattccaggcatccctagagtgctttcactggatgactgtttttattacccctctacccaaaataattattatctattaatgcgtacatttaaaatccaaggagtggtttaaatgtggttcaattttatgggaaaatagctccaatagccttgtatttacagaaatgtaccaatcttaaaggaacatagccactcaacaaagcgaagtgtatctgttcagaaggaaaccaagaacactccttcaaaatgggttattttaaggaaataatttaggttaaaaattagagataattttgtcttcagaagttttcagctgttaagcatatcactgccttaccaaagaatacttcagagtctctatttctggaaaaataattgtaagagttaacaactgccattcagatatgactaggggtaatcttacatggacacagaaggatcaactagattattttctatggaatcttcccagatccatgaatcactgcacactaaatggatgtatcagatttcttgtagattgcatttattttcacctatgtctcagtaaaatgtagaaagcagggaatattagggaatgtgggttaattttctatctaaaatcctaatagcatccaaaacccacttaaatgattaacattcatgacatataaaaattctcgataacatgcttaacgaatcatgccatttctcttccccttctccccctcctgtccttgtctcctccttcttatcctagagaagtagtaaaagtggaagcctcttggcctccaaagaaacctgaaagttatttcaggactctcagaagacttcttgacctacttgtatgctgggaaaaaaaggagaggaaaagtggcaagaaatacgtacagtttttaaagttatgaaaaatcaagcatttacacttgaaactgtatatgtaacagttatcatgctctaagacaatgacatcagttttctccttgtttttgccacctatagtttttgttgttgttgtttttgagatggagtcttgcgctgttgcccaggctggagtacagtggcgcgatcttggctcactgcaagctccgcctcccgggttcatgccattctcctgcctcagcctcctgaatagctgggactacaggtgcccaccaccacgcccagctaatttttttgtatttttagtagagatggggtttcaccatgttagccaggatggtctcgatctcctaacctcgtgatccgcccgcctcggcctcccaaagtgctgggattacaggcgtaagccactgcgcctggcctgccacctatagttttaatatacgatgactgttcctgtcttctggggtcactactcccttatatctaggaaagcaatccaggtagcaggagatgcgaagacaagtggacccacggcatgctaaagcaacaactacaggctctatggtgccaggcaccaggctgcaaaccaacgtgcacaaaagaaagtaactaacccagaaaaattgggaagaaggctacataatttaacctgtgcagagatgaagctaaaaactcccaatgactctctcccttggctgatgtaataactcatacaaaaatatgggttggcaagaagttaatcaaaccaacccattatctggaaagagtgttcaaattctacttgctgcttatgttgtctgaattagtcttgaaaataaccagatattatttttcgttaaaaaaaaaaagcaacagagatagacaccaggtccactggcctattgttccacatttagagtacataactagaaggcccattctagtcaccccaattgtatccttccgtcctggaagaggatcttctcatgatttttcttttcttcaagtgatgttcatcccctatttatcctagtctctctgcactgacactaatctgccttgaaattggctgattccgctcgagccatgtttacaggaaagtgagtttcatcaggccatcctgttcatagaccagtttatgctccacagcagagagattattaaaaactatatattacgtgcatacactttaaaatgacttgggaaagataactgtatcgtatctgcatttcattgcctgggttgtagaaaggggccaggtagcattacaatcttgaatggaaattgtttcccaaatatattatcctctgtaagaaacatttagcaactgttagtgcccaggagacaaaggctaaggggaaacaatgtgtgtaatagaatgtagagagggataggaagagagaggaaaaagactcatttaaattatcaacctgagcattaaccacaaggagagaaaaacaaatgttctatcttttgcacaaacatcaattacgtctagtaatttagctgattcctctcactgaacaggtgcgctggctgcagtgcaaagtgaaaagcgtgcacaccactctggcttctataaaaggtaccaagggtcctcaacttgctctaaaaaaaggtttccaacatatcctggaactgccattattgacagtttaagccaagcccctacctgctatgtggcagtatgagagtgaaacccagtctagagacttgccatttcaagtggctgcaaattgggggcaaagagagtaaactcaaaaagaaattatggagatggacatggatttagctatgtaaagccaactgaattatgcttgacaagggaaagcaggatgactgaattaagataactacaaacgctaagcataagcaatctatttaacttgctcataagaccaagcccaaaattgcttaaagaaccagaattggtcatttgagtttcattcccagatccttttctattcagatcctaagaaaacaaagtgaccgaaagacctaaagcaagtagggggaaaaggtataatcaagagccctgctaataggcaagtgaattaagcggcttccaaaaaaactaaaaactgactataaacatatatacacacacacacacaccaacaaaggagtaagttactctttgccatagttagcatttaaaaactgcagaatgaagttgaaatacatggagtttcttctgcaaagaggtacaatgctagtgaatgaagcatccaccaacttgtttccctgcagctcccacaatgcggagtgaaagaggccatttatctgtttctttgttattttatcatcatcataagaaagaaaaaagaaggccagagacagcatcctttaacactctttgtttactctctaccttgattattgatgttgattctggaagaggacaggggtttcagtgaaaacaatggtctcaggtactaaagcatctgttccactgagttttacccgtgtgctaagaaaacttaaatgacttgggtttttcttcttctgcttttagttaaaattccaaaatatctccttctagaaaccctgccagaaaaagtgctcctgccttttctcaagaatgaatagctatattcccttgtcttatgtaaacacatggaccgcagagaatttacgtaagaccagagatacagccatttgtcttccatgactctcattggagacggtgatttggatagacaaatcatacttccataccttgtttcctcatcggtataaagagtagcatagtcatattgagccatctaccaaagcaggtaagaggacgaaagaaatggctaaagaaggctttcaagacctttagaaaaaaatgctaaaagaaacaactcatctcctctcttggagtaattccttcctatattctaaactctaccttccaaacagcaacctgaggaagaataacattcttggaatgcttccaaagcagttccattaagagacagaatttgtagttctgtgtcaaatgttggtgatctaggaactctagatatagacataatttttttttttttttagacagtctcactctgtcacccaggctggagtgccgtggaatggtcacagctcactcagcctcaacctcctgggctcaagtaatccttctgcctcagcctcccaagtaactgggactaaaggcatacaccactaggctgagctatttttttttctatttttttgtggagacagggtcctactgtgttgcccaggatagtcttgaactcctgagctcaagtgatcctcccacctcagcctcccaaagtgctaggattacaggagtgagccaccacacctggcctcatggacatgattttatcttaaaggtaaatggtgtacacacataaaggaagaatcttacttgttccatagtcataaagctggacaaaactcactgcaaccacaactgctttcagaaattgttttgagaaataatgcaaacataactcctttagtcatctggatagtttatgtgcctgtatttatgtgcattttccacaccaataatcatagacgcttgtaaccagtttggttcttaatgcaaaaattttaacagttgtgtgggtgggtcaagaggggagtgtatgtgtgaagcaaagctatcattgtacatattttactaccatctgttgtttcaataatttttaattacttaacatggaattctcagtgctgagaataaattttaaagtaagctaccctgatcaaatgttttccacgtgtttgggtagggtgggctgggaggcaggggagctacaaagatcaaaggtcacaaagagccctcagccaacataggtatcttacacggctggcacataatgtttttaaaaacttgagccaacatttaaaagtcaatgtggagatggcctaaaaatttaggtaactagcttctcataaaaatatggtagcatctggcaacactgtccatattaacattcatgcccagccatagagctgaacaccaggtacccctggaggtgggagctgtactctccagctgaccacagtccccacctctccctattctttccacagcatcctattttcttcctttgtgttacctgctttgcctttattggcatgtatgagatcccctcatatagatgaaggaatttaacccatggtagatgcttaataaaaatgtattgaggccgggtgcagtggctcacactgtaatcccagcactttggaatcccaggtgggcacatcacttgaggtcaggagttcgagaccagcctggccaacatggtgaaacctggtctctactaaaaatagaaaaattagccagatttggtggcgggcccctgtaatcccagctactcgggaggctgaggcaggagaattgcttgaccctgggaggcggaagttgcagtgagccaagattgcacgactgcactccagcctgggtggcaaagggagactccgtctcaaaaaaatatatatatatatataaaatatatataatataaaaaatatatatataatatataatatatatattatatataatatataatataaaaaatatatatataatatataatatatatattatatataatatataatatatataatatatataatatataatatataatatatataatatataatatatataatataatatatattatatattatatatattatacattaaacatatatttataataataataaattattaatttttaataaaaatatattttatatatattatatatagaatatatagaataaatgagtcaatgaagaatcaaacattaaatatcattagagtaggcaagcccaaaatatattccagtttatttccaaagcagttactttttgtactataaattttataaatgtattcaagtatattttcaaatagatttccaacatttaaaaataagtttgtataaacttcaattataccaatgatcaatctccactaaatcacagtacacttttggtatataaatttgaccaagaagtcaactgatggatgcaaatacacccctcattcttcagtaaagtgaagcgaaatatcacatgattattggcaacatggacatgctttaaatagtctatgaatactctcatgtttttaatctgaaaaaaagacctctctcaaactaggcttctaaaattacttaaaaactggtctcgatgtcgaggaaatgagacagaccaacaatatgttatctcttagctttaaatttattccatgcaggttaggggagcaccaggccgcagtcagaacatgactgccaaagagatgcagggacaggctcttcagaaaaggaggatcctggagctggaataggaccttttcaatgtgagcgaatcggcatctgtgagcagtgcttgcagtggagctgtacacagacagggaggtgaagtgaaatctgtgactgggagtaagccatcacacttcctaatgtctccacccaaatgacaagccggagagcccactgccattcttttctgcgaaggaattcagctcacaagccatagtggagacaggaaaagccaagcttcttttgactaatttttctaaatagccatgaggaagcagtgatgaggcaaaatctgtcaaatttaatgtttcacaaaagcagcagtgcaatatattaaaagagatgtgagaaactaacctccagaagggattgtggcatgagatctctgctcatgctcctagttagcagttcttatgtaactgtttgctatgtccatggctatacatcagcacctgttttgaaacagctctgagagcagctgagtgagcccatgactggaagaagatactaatcagatacagagactcgacccttatgtgcactcctcattgtcaatcatccatctgggactgtcaaaacaaggccagtctgtttccaggagcagcatctgcccagcacaggaccggacttcagtatccaggcattctgtggctttgcaccaggagaacaaatctgttctttctggaaggagaggagatttccagccaaactgtttgatgactctaacgtggtcgataatgccaagactacgataggaaacagcactgcttctgacttaaagtccaacctgcttatggttcctaagacatgtccagttttgtcagagatgttcaaacctcgagagcagaggggctccacgctggctgcacatcagaatcacctagggagctttcaaaaccaccaacagtctggcctcacctgactcaaattaaatgaggctttctaggggtaggtgctagcatcaccctcacccaaggtgattctaaacatgcagccagcattgaactatgggaccggaaggattaaagtgaaaaaggaaatagaaccagaaagaaaatgttaaaagaaaaaggcagaataaaagacagaatgttgctataaaaggatcccaccaccactatcaaataattacaaactcacccaagatctcccacaatagctcagatctaattcctttcctgacccagccatcatcttctttccacctgaaaatccttctggtatttataatccttttatttttaagctactaaactagaattacattctgcctactggagaatacttgcttctcataaaatagttatttgattagttaaaaaggtgagacaagtcaaggtatgtgcttgttctctcattccttttcatgactggctcttcaaataattaaacttgaatggaaaaaaggcatcttgtttcaaataatactgtaacctgggtatatctacctcatcaatacaaactgattcatctgtgctaaaaatgccacattcatgatagtgttaaaaattgtgaggctcttttatcaaagaccagttaggaaggtaagatggattgttaaagattatgtatgtagacatccattcataatcacctttttaaaaatgttgtaactgaatgagccactaaagctacaccaggctcataatgaggggtaaaaagaagggctgctggtggtactgagaggcacagagacaggaaaaggaagacagaaaggcagtcttccaaggcagggggcaggaggagaggaaaaactgagccaggtcactgcagggtgtggcagtgagaggtttggataagtgtgccagctgctgtaatcaccactatccacaagccaaacccttacacataagctcagagattcaacttttttcaaaagttaattttttaaagcaaaacccaagttaatagaatgttccagtaatcccctatcatcaaattttactcagttggtggtgtggaacttcatttattcatatttttagctacaaagtcagggcctgctttctcccaaccattttctaatccttccccttcacacagcactcccctgacaggccttataggcctggggaaatgggagccccctgttttaccccgtatgcactgaccagcaccggtgaaattacaacacccaggaatgaaatacaaatcattattcccaaatacagacagcatttaggcctttccattgctcaaccgttcattctcatgacctggataccaaagcagaccttctggccaaaacagcggctaagtgggtgtgccacttttttttattactgtatctcatatcagatagtttaattttgtgtaatttgtggtatatggctggattacaagaaaaaacaaaatgaaatcaaagaaaatatagaagaaggaggaagtggagtcattggtcccccctttagtaaccaaaaaagtacactataaaaaccaagattgaacctttggtttaatttttttttttaaactttgattacacagttgggtcggtttgagaatatggtaataagtataacctttagaatgaaaggcaggatgagcagatggaacctaattaatagtgaaatattattaatctgtctccctaagaggaagaaaagtcagtcatattttacaaaggaatttctctgtacaaattaataaaatcagacttactatacaacaaggggctcactatgaaacaaatatgtttggtataaacctttaccaaaccccaataattaaaatcacttcaccctatcctataaagcttaaatataccattaatatgaagctcagttgttatatatcaccacatttttttacattcataatttaataaatattatttacagaaaaagaagcaataactcatttttgggaagccgggaaagggaaagataaaattaatttactataaactcaactttataattttcctgaaatcataaaacttatttagaaaagtgttcacatctgagtagcttccctgcaatgccgggggtaacacccattcccctcagtgtccacaagggattagaagcccaagattcggaatcagacagacccagatttctttcttgttttgctactgctagctgtgtgccacatgcaagttaattaagtctttcagtcctcaatttactgatctctaaaatggggataaaatacgcacttcaaagtgtcaggcatctacatacccaataaatgatacctattcagagaaaaagatatataaacctaaaaaagcaaaaatgaaaaagaacacatattcatagctggcaataagcaaaaggcttacatttactccaaatatttatttttttaattgcctcagaaaaaaatattcccttcctcctatttcttgtcaaaacaagatagaaaaataaaattcaatgggaagcagtacagctaacattttacttaatactactttgttacaggaaaattcaattttcttgtattattttttattatggcaaaaacataaaatttatcattttagccattttaagtgtacagtacagtagtgttaattatatgcacaatgtttccaacacatctctgaaacattttcatcagccaaaactgaaactctatgcccactgaacaataactccccattttccccttcacctaatccctggcaaccatatttccagagcttgactactttagatacctcatataagtagaatcatttttctttctgtgtctggcttatttcacttagcataatttcctgaaggctcatttgaggtgtagcatatgacaggatttctttttaaagagtggataatattccatggtatataaatatacgccacattttctttatccattcatccacggatggccacctaggttgcttccatctcttagctgttgtgaataatgctgtaatgaaatggatgtgctatttcttttagaaagtgatgactttccttttttaaaagtaatttattaataattttgataattcaatctttggcctgcaaatatatacaagttatttaacctataaaattgaaatgtctctctctcccagcaaaaggaggtagatggaattagcaggttttgacaacactcctccattctccccgtccaaagtagacatgaggaaaaaaaaatactgaaaattctatttttgtcaccactgagactttacattctgagaaaatcaacaaactgtaacagtcctaaaatgaaatctcattggcacttcactagacaaaacagaaagtcagttgacaaaaattgaattaggtggatcaggaccccaggacccaagatccaacatttagctctggtacctaataactgtgtggctttgagcaagttacttaccttctctgagcttacttcctcacctgtaaattgaggtttaaaacactcatttctttcaggactgttgcactgataagaaccacgcacataaaaactgttttaagaaatacgtcattttaaatttgattacaatattttaaaaagatccatcaaaaatatttagtaaagggaataaaaactactatttaaatcatcttaaagcctaaaattagctatcgaagtgaaattatgtcctatatatctacataccataaggtatgcatgagtaggcaaagacagataacatacacagtctcgtcttggtcaaatttggtttccatcagacaacctaacaaattccaatgtaagcttccactcagccaacattacttggaaatggattcatcttccgcaaaattatttccttccactggcactgacccatcaccacaaaaacatcatctagttttttcagagcactgaattagtagctggatgcaagagctgaagaacgtcttgaaacatggccatattgtatcacacagaatatagcttggaaaaatattacttttcacaaacaaaaaacttggctagagaaaggggggagagaagattaaaacaaaatatctcccagaaaaaaagtgtagaaaaaggaattgaaacaaaaacactgaaaattaagtgtactcaagccttgtgtattgttgctgcttccaggagatgaattctgaatataacaagatgaatttcaacagaccgtgaaccagagattttcaacatgataaaggggaaacgatatatattcaatttttacaagcactgagtgagcagaaaactgaaaattcttcagctgctgataatgcgctgatagaagtgcatcccccgacagaattcctaatgaactgccagaaaaatggagaagtattaaacaaatggagagacctaataattatctgtaagcacactaacatggatctctaacaacttctgtagtcattttcctatttttaaatgagatactattaaagaccatttgaataatttattcaaccatttacgataactttaagagtcttcaaagataatagaaaatcataaagtaatatatgtaggagataatgtagaatacctactatttattgaggtcctaccacatgtcagatacaatgataggtgcttcacattcctccccactacccctctctcagtaacaaagaggaaaagacacagtgttattattcacattttacagatcaggaatcagaggagttaaataattttccttactgcagtcctgccctgagtcctgcataatttttaacatcttatccataatcactggctctgacaccaaattgagtggaagagtaaatactccaaaagtggagaggataagcaaaaaactaaatttctctatgaatggaggaaattaaattataggaaaagactagttatacttaatatagaaaaatcaaggttcatagtggaccacagactctgtgcaaaaccagatgtgatgagaaataagaaacaaaagaaagactggacaatgaaacagaattatttacttgaaaagtttataatctttcctttggaaggctatgtacccacaaagcaacttctgaacccataaatacatacagataaacatacaggtggtcttataaaggtcagaattcagaatcagaattatgaactcagaccagtatactatgacactaattttttgctcacggccagttatatttaaattctctactcttaaatctcaatacaacattttttcatgctttttatctaacatgccgaatgatctaaatgaaattttaatatttcactgtatggcaaaattccacaatgtttaactctttacatctgactgtgaaccatttcttttgaattacattcattctctcttagcttaattcactgagttaaagatgctcaaacagaccaggactgagtcaaatgaaacactaaacgcctggattgggggcatcctacagttcaaagcatggcttccctagtcaggaagtcactgtggatatattaagggaaataaaaacatgcatatttggtttttctgtgacttaagaagtctacgaggaaatgggcacgggaaccagaggataaagatcagtagacacatatttgaaatgatgtgtgtacaaggttattcattacagcattgtttatacagcaaaatactgcaaacgatccaagggtccatcactagggagctcctaaacaaactatagcacatctatacaataaagtggtaggaagttgtaaagaataatgaggaaggtctctttatccaggtatggacatatttccaatttaaaaagcaagatacagaacagagatatgctctgagtatgatatggtttaagtaagaaagtagggattataaaacatatatttgcatatgcttgcacaaaaatagaatactcagaaaactaataaaagtggcttcatatatggggcagtggggaatagggtaatggagacagggacagaaagcaagatttctcactctgtatctttttctatcatgttgctgtttgaaccttctgaatgtattaactactaaaaagtaaaataaatagatctacagccaattagaaatcgatagaaaactttttataacatgtagtaatcataaatatcactgcagtctagaaagatttgttaaatattttatgaaaagtagctacctatagggcatggaacaaaactttaggaatttgatgagaaaagaagaataattgccaaagtatgcttctaggaaaatcctactgtagtgccattgctaggaagactccagtgagttgctctcattttcagaaatgcatctccgaggctgtgccttgcagacacacaatggcagctgcctttaggcaggtagttggaaaaacctgaaagtacctgctattgtccaaagcagcagcttcccttcaggactctcctcaatctcatgaataccttccaaactcagtaaaaaggaatgtgaagtagacagattcaagaaatgaaaattacaacaaaacccagaatgacagaagaacctggatgctaaagttcccctgatgtcatccagatattgaatatgactgatcagtgccattttgggttaatcacaggctacttcccagaggaagtgaatttgagctaaggtttgaaggtgacagaagggaaatgaatgccaagttaacaagagatgaattgcagtaagatttcacagagctatgtgaatagatagaacagtggcacagaagctgaaatgtgggcaactgtaatggcatgcatttaagggaaatgaatataaattactcttggacgatgatcagttggctacaagatgtcagttacaacctaagaagaggaactgttggccactgatgactattcactaacgattacaacctaatatactgtggtagcccagaggccagcaataaactgaaggtaatcagctaagttaataaaaaatgtttctctttttttttttttggccacagagtctcactctgtccccaaggctggagtgcagtggcaggaccttggctcattgcaacctctgcctcccaggttcaagtgattctcatgcctcagcctcccgagtagctgggattacaggcatgcaccaccatgcccccttaattttttgtatttttaatagagacagggtttcaccacgttggccagcctggtctcaaactcctgacctcaagtgatccacccgcctgagtctcccaaagtgctgggattacagatgtgagccactgggcccagccaaaaatgtttctctcttaatatacaattctgaagtatgtttaatctggtatcccatcttaaatctggacctcaccccgtgaaaagctgaggacaggttagaggagagaaagattccgtatcttgattaagatacagaaaagcccagaagacctataaagattgaaagccctttgtctaaaataatgaaagctgagacaagcaatgatcaagttcttgttaccttcaaacctggtaaatgtgaaaaattaaagctagcagtccctataaagtatgtggaaaacttagagaactcatcatccctagatgagatacatgctgaatctacaagtaacttcgaaagaggtttagattgtttcataggaaaagcattcataacatattattactagaaatcaggaccattcgtactatgttccaagggaggagatctttgactgtccacaatgttttggccgcattggcaaagaactcatgacgcaatcttacctctatctcagctcctatgtcagctggcagggctgacagtggggacatttcaaaggaagataacgtaacccataaagcagagcgttagggaagcacagagtaattcactgccagtctctgcccaccactgtactgggctgcaccatcttcaggactgtagaagtaagtgtaactctgagaaaacaaccaaaatgaatcaagcatacaaaatcaaaggaggttaggaaatctatataatttaatcttaagaagagagcaaaataacatgaaaaatttctcagttgattaggtagataaggtaatgaccatctttttaaagaaaataaaagtccttaagagttaaaattagaaagaattgcctgcaactgacattaataatacttgctaagggtaagtgcagtaactgaacacttattagttgctagacattgtgcaaggtgctccaaattctttaactcatgttttttccttttccttttgatcgttacctttacagaaacacacaaacaaaaaacaaaaacacctagataatttgtggaggtaagctggagttctatgaatttaacttcatgatgatgactcgttgagacaataaactatgtatgccacaatattcactaaagaagtaagaagtttcctcaaaaacctatgtttttggagtctttcacagctttctaggaaccaattattttcccctttccaggcttattgcatgtatttaaactatcccttaatttactgaatactaacaatgagcattactccgaatttaacgctggtgaatctcgggaaagagacgtgagctcacagaggaggcaaagaaggaatggtgatttatgatcacagaaaatgtgcacgttattaatgggactcaaagcaaaaacatgtttcatatgaggagctgttttcagtctccatttaatgcaggagttaaatttggaaaatccacaggtacctcacttatctatatataacatggcttttcataaaatgtttgtaattctgaatattgatgaggagtatattgatgagacagaatttgggacttcattacctcgaaacaggcctgttaatgtatgtggatgtatcatcccaacaaataaccattccaagaaagaaaaaagtcacaataactatggggtaaagataaaaatcagagcctattaagcctgccattagaagggaaagtggaattgcttctcattttttggccaacaattaggaaacccagaacatcaggaacaaaacaaacgaacattcaagctaaatgaaaacagcagtttcagagcccttatactttgttcagcagaacagaggtagagtgagctgtgcattttcccctccatcccccaaacacctcacaggctggggacaggactaataatttgacttaattacatggtaatacttatctggattcaactagaaatcctcaaactggtcctagcttacaaactgagaaaggaaaggaaagccgatttgggattctggaagtcagagcaggttcccagtcgttagacgtggcagaggagaatagaaatgatcacaaaggaggaaaaagaaagaaagaaaaaaatactaattagaagagcacagtgactagaggccatgggctttgggataaaaagccctagatactggcaggaggcaggagacgtagccatctgggaaaaatcataaagaagtcaggctaaacctacagacctcgaaggctcccgagtgcattccggtattaccaaggagttcaataaatggtgttcttaatgagggtcctggttctttgagaaaactcaccatacttagtcaaatcacttcttgtaatgactgtgacattttagaacatttgcaatgagagcagttataactgtttcattgtttaaaggattaagcagatttaagccgaactcctccttcctggacactctagatgaattagctactgtaaggaagggtgtagttcaaggtgcatcaaagagtcactactccttttaatggaattttcccccattccagtcttagcttagaaaggaaagaatatacagaattgactgtagtttctcaaggaaatatcatggcaatttttatccctcactttcatataaatttagaggcttttctaagtgacaggataaatcactgtctctgatacatgaggatttatacttaactgagattagtaggccatacctcaggagaacagcgttctcattctgaacaatacgcatgaaccaagggaaaggttccattttagtcattcacttccataaaatgcaagttcatttcaattactactgtggctcacctactaacgaccagctccaacaacataaaaaacattaaatcaccaaatttgtcatcagtgttttacatgtgtttcccatgcttggtaaagtacgtttactgagagcaaagaatgttagaagtggaaacaagctacagacaccactctcgtctgtcctgacactctaaccgtgaggagctgtgacttatgttagcaagtgaaaactggtaggcatgaaatttcttttacaagagcaagccaaagtgatagcagaaatttactttatatgtatagctttacagaacggcaatgtggttcctgctcatagaacaaagtgagttaatctactttgcaagagacaatgacctttcaaagcaagctgtgataggtttatcccttaccttacaaaaagaatatcagttctttagcaaaaccataaggacaaggtaattttgtaaggactaattcaggtactcctttttcaaggtgaagtacacacatttctcaaatctttggggacgtgaaccaatattattctgcaatatgcatttaaaaatcagataattattggacagctaagcatctataagagaatggctattcccagtcaccaatattaatcttttatttatttattttttaagagacagggtctacctctgccacctagatgggaatacagtggtgtatcacggctcactgccaccttgaactcctgggctcaagcaatcgtcctgcctcagcctcccgagtagctgggaccatgtatgggcttgcacctggctctgatttttttttttaaccaaaccaatttcctatcttaaaagtcacaagaagagcacattggttgtgtggctttcatgtcttacttctcaacagcaataagaaataaacatgagctggaagagagaaacagaacactagtctcagtgaaggaaataacttaattcagcacactgctctacaagcatctgtctttggtctcactgcattcaaaaaataacatggaaaaaggaatggagacatgagtaacacatataagaaaaaaataattagaacttaaaaaaataaatatcataatgcaagttgcaacccacttgccgtgcagacatgtcagaacacagatctgtagtatctatattcatcactgccaggcgtattaaaatagaggcagaatgtcagtggcaggagttggcatgtgtacgaaatgtttaagcgccctacatgattctgatctgccccactaggtcaaaaatcactcatctattcccatcacggtagttcactcagcggttcactgtctcacttagtgcttaattgcgggatgttttcataggtccactggcacctaactaggttcagactgttttaagtctctcccaatctacaaatggttatctcctgcctattcataggcacctgcacaccagcagcctaaagacagtggcctaaactagttaaactagttgattcttcataactgtttgcttttgatcaaaaagggcagcaagaaaagggccagtggttccactgggaggaaagccatgtgggacaaattaggtgccgctgcaagatttaaaagctcgggggtggggatggggggggaagcagagctaactagaggcagctgttaggatgtggtttctgtgtttatattcttctccttccccctaatgcctcttatgggtattaggaaggaaagcatatatatgacccagcagagaggatcagctctcttgactgtgcatgatgccgagaccataactcagcacattaatgacaaaagttacctggcaagagaatgaggtaaacctttatttgaaaattttttgcaatcttcttttatctaaacacatgaatacagcagaaaattgcactgttagcagacggctgtcatgataatagtgagaaaccttataggagcaataaacctgagctacctagagatttaaggctgacctaccagtctgcaaatggtacatcctgttgctattacgacctttacccccaccccccgccaccccgacaatttcaccttcaaactctcaacccaaaatttcaatatggttcattgccagcacctttctctttttttggggtgcaaaagtggttcgttgatccatatgtatttcaacaggctttgactgagaattaaagtcacatactatttaaacaacacagagattgcattgttcttacaagaacctcccttttccctgcctgccccaacctctcttcccttcaatattgtcctcaataacaggctttcttccctccttgtaaagcccatatggggcactgggaggaagcagggggagggcaagtatttctatttctcttggcactgaataaaatggttttccaggggatggagtatcactctcattttaataaaactcctgtttcctgtataatatcactcaggtcacttcaaggtgagaaggtgatcaaaaacagagacgagcagtggactacacttgtgaatagcactcaacagggcccacatgctccaaatcaatgcagcatgaccaagtcctctgcccaatcatccagctactcaagtattgcaaatcttaagaattctacgtgctcagacaaatagctgctgcaaatacttaatgcaatgaagccactttttacttgactttttttttaaagtcctttcccaaactgtggtattattacctgtaacataatgaacattaaaattgattttcaccagctcatatgatttgcctacacataaggctttaatgcagagtaaagaacagattagaatagcattggcctcaacttttaaaatagcttttctcttcctactgggtgaatgagtacatgaagccacttgattcacacagggaaacttaattccttcctcattctctgccatctatccatctacctgttttgtattatttttaattgctttgatgctgcactcctgctactctacccaaatcatagacacacacttgcacgtacaacacacacacacacacacacacacacacacacacacacacacacagagctagtaatgcggtatagcagaatttttatctgagccacatattagctgtacgactttggaaggttacataatatctctaaaacttcaatttcctcttccataaaatcaagatgataattcctgcctcatagggctacaaaatatcacagctgtagtaggcgctctataaatattagttcccatcttttcccctctctccgtgaacaatgcactctgatatcctttaaatacagactttacagatcaatgaatagaaaagggtttctcctggagtttgctgatgccaggaacagcgccctaatttttttctctccattgttaatttctttttaaaatacttcttaccccttctttcacaaatctgtattctcctatcctaaggggattgatattttctttgtttctctatccaatctttctcaaaggtacagagatctaatataactatattaataataggtaaacaattgaaacaaaaacatgaatatggtcactctgccattagccttgagtttcaaagttgtgtttaaaatgctaaaaatctgccactgcagtgaaagccaatatgaagtgtatatcctaaaagagattgtctgcaaatacaaatgaaaacatttctgaaccagactgctatgactaataacacaatttgatacattagaatagaaaatggtggaggtttatgatccttctcccaccccgggtgggaagcacactcgcacacacttaaataaaacggcgagtaggctaactcgctgcctgctagagagggcactgcacacatttcttttccttcttcaaacatttgcagtagagtttgagcccagttaatcaataccttaaaaaacctgttttaagacaacactgtctagtttgctttctggccatttcaggtacaaacctttaaaacgaattatattttttttcacagatttcagattttactaacctatattacaagtgacttttaaaaatattttgctactgtttaaatcaatactcatcatgacatagactatgtatgatatttggtagctgaacttgtatcttttcagctaaaaattcaaagttggtcttctttttctccttcacctctcaacacagtttcttccaaacttgctgtgaggagtggagggggagaggaaggagggagtgtatgaccataggagggaggaaagcaaaaaacaaataaatcttcagtgtcacaaagggcctcaccttgcttacggtgcatgacccacatctataaaaagacctggaccagacaaacctattacatccttcagcatttcctcctccccctaacacttctctcataaccttccaaagctgccaccttcacaataaaatgcagataagctgtcagagcctggtagtccaagcgatctactctccatctgcttgcaaatttcatggaaatttttaaaattcagcaccatatgaggaaaacaacgttcagcaacgtcaaaacgaacacagactgagttattctctgaagagggctggcaatgttacatcactgctgctgcaattaattctgaagcatgagttgtacttatcatacagaaatgtgtaacttcccctgaagcaaaggcttcaaaagctaaatgacagatgccggcctctaggtgtcttgtttgctgctcagaatgcttgcttttcagttcagtccccaaatggctccgccattctgtgattcacattgtacctccttttgagcaaccgtgttaggagacttgatgtagccatcgatgcaacaaaatgaagacagattcccatgctgtggtccacagtctcatacacaacttaaaatgttaagcctcattcatcgtaaaaattcactgctcaaactctagttttccttcttgttcatgcagacactttcaaatgttatgtcccatgtagacagatctttctgcctgcctatctcagctgaatatgttctttgcaaaatattccctttgtcccctgcatgtcatggtgccgggaggccaccagcagcaaggtcctgagctcccaagagaggtgccccttaaagcaggagatggaggcaccaagtcaactataacttcatggctgtgctttatcttcctactgggcaagacacacccacgacttcatggctgggctcacctttcacaaagtgtcagcagagctgcatgtggccacagccttcaccctttatccacaatggcattaatgatggccccaagcaggctggtcccaacgctcggtttattccagaagctgaataaagagatcagtttctgtgaatgtccaaatacccagccaacagaacactttactagaattgggagggctctaggctttttcattaaaccctaaatagtggctttctaattgtgatatattcaataaatggagcactacaaaacttcctggttgctctcttcatctactgaattctgagtgttatagttcttcctgcaaaacatgggccttgcatattccatacacatacatatacagctacaataatttataaaagaaaaaatctcaaatcatcaagtggctgttaaattaagtaagaaggaaataggaagaagaccaactaaaattatacaatgtaattaaaagggtatcctctctacatttctaataaaacgcacttggttgttatcatgtatggttgggtacagtttctaccccagcatccaatatcacacaaagaaacaaaagcaatgagaatttactatcaataatttccattcacttaagcaacaactaaaatctgtcattattaaaattacctataagactggtaattaaagctaaccgtctgccatgccagccctcctcctgccttcccgtgacttggcctcctttgatctttctctcctggttattaacattagcggcaggagtagtagatccacgtcaaaatcagaaaaataattcctaagcagaagaggtcttaaaacacggcaagtgtacccaatgctgatccatgcaaaaacagggaagaaaaattgccgctgagcccacgtgagagctggaggctgcaccaccaaagtcgcctcaccctgcgtccaccactccatccacagtgttatgcagggaaaacggatctctgctaaaattgtttcttcctaaatttacctgcaccatactagccatgcttcccaaggccacaggcctccaaacacacagtccttgtgccttccaccttagccctcctccagccaccgtgcccctgcccgccgccgactagaataagatgactgaatggtgcctcttgaaaggtcgtgataacaaatccaatttacgattatcaaagggacaaaaccaaaaggtggaagagtctgaatcagtgaaaaattatattatcatttaattgtattcatcaacaagatcacctctcatttaagaatgagacagataggaatgttcaatagaaagggaagggggaaaattgcagggtgggaatgggagggaatcccacctgtccttcaaagtgtaaccccaagttaaattctcttctattatttccgtccttaaaatagtcagatagcaagatgttcaaaggaacacaaagcagtatagtagagctgccttctttcaaaggggccagagcagcccttcgaagagttattcaggtcacagggaaattacacttctttacgcatctataaagaattcagagttttccatttttattagcattattataatattgaaggttttcaggcatatcatgaggggagcatttacagagacaagctgagcagacccagcctcacggcgcacccgccccgcttgaagaagttccacagcctggcagacattttgaaaagcctaataagcacatagcacttcgactgttagtttatatactaatacagccaaacacgttacgtgaaaaagccaagattcagttgtttttgtcaactattagactcaacatgatactttgtctctatgaaggcagactacttggggccactctattcctttgataaaactgtcatgctatcattgaatcatcacaaaacgtatctctttttttaatcctttcttaatttttgcaattgaaaaactacaattaccttttgattatttttcagtgcatacagtgtcaaagtccccagttcctgatataaattccatgaatatttgaaaaattaatacaactgtgtcacccattgttcattttattcacatctcttctcgccttctccctggcactttttctagcagccctgagccttccatagcggcacggaggcataggcacatattcaaaggtagaagactgaaaaggtcatatagcaagcagagaattttctagcaacgcaggtttcgatctttgctatttcagtgttattcccgctgagcctcgcgtgccaagaataccactggcgctgttcagagacactcatgatgactcaatggagaatcaggcgacctgggcatttaactatgcgcctattcccaatgatattctgtctcaaatcatttccatcctcatagaaacatgaaagtggggcaatgacagatatgaagcccagcatgaactgcctggaagaactctgcctagcaacacagctttatcactccaccacgcatatgaagccagagcccaccgacaaaaataatgacataaaaaccaagctggaaatgctatagtttaagaaaagctacaaaaatcgtatcacagaagagactgtttaaaatcattttacattcaaccagtaagtacaaatgaaacattagttgatattttaacctacaatgaagcaaatactgtgtcagcatacacctttttgctatgtaaaatcacacgtttcccacaaaaacctatgtttgtaaaattccacgggaaacaaggtaaaacggttcgctcaagtcttgccttagcgtattcctcaatatagtaaaagagggttgggattactttgatgacccttcaagtccggtatgtaaatatattaggttttctttattctatttcagtgacacacatacatccagaaggttatttcctttatttttctctttgaggattctgggttctaattgtgaatatgtgaatatgacaggacacagagcatgagcttataatttttattcacaggagatctaagtttgtgctactatagtcacagtgatctttcaactggttccaaagataaatattggtgaggcagcaggccagggctcggatgggcatttttagtactgaaaaggaattaaattagctagttgaatgcagcatgaacccaagtccttgacttgattagtaacacaaagcacactgttagcagtgaaggaaaaaacgaatatgtaaggagtagttatttcaaatcattttctctgctcgttttcatttatggaaactaaatgggtaactgcttctgttcctatctgcacaataattttgacaacatattaatataatgttaacataggatggaaagtgggaattagcaatgattaacagatattcttcaaatatatgtactttcttcagaagttaacaaaggatttgaacataaattctaccatgtctcaaatagcaccattcaatagaaagcatctgcacaaaaattatctcaggttattttactagtactacatttatttctcttattactttctgatgtttcttgggaggcaaattttactgataaatatgtaaagttgattaattatactttctatatcatgtataatgagttgcattataacaacataataaaattatatagaatccagaaatacatgaattattgaggaatgtcaggtaagaccatcttatatggcctcctctgaactcttaaaaccagacaggttacaaccaggaaagcctatttgttgctagaaactgcaatcatcaatagcccaagcaagcaaaacactggtcaagtaaaaattctttttaaaatataatttgaaatgcaatttaaaaaaaaaaagttcatccaaaatatctaccttgattagacagtaaacataattggtaactgtcaaggtccatacagaattagtattaaaaagttatcagtgagagcatgttctttgtttagtcaggatatagaagcaaacagaagcatatcactgcaatgcacagtgaagaactggaacaaagctgtgagcagctctccaatataaagaccagggttgtgatattcccgtcagtcactgtattaatacagggaaagcctacttaatgaactgctgagaatggaacagagtcactatgagaatacattttgtgtttaccagactgtaaaatctgcaataagatcccagaatcctcttagatgaatgaaagttaaaggaaataaccttctagacatagaaactcagtagcaaaacagggaataaaataaatagtttccaaataaaatttctaaaagactcattgctttggcaaaagccaaaaaaattgcttcatcatctacgaacagtgatacagtaacacagaaaactaaagataatttcctgaaagacttgaaactctataaatttaacaattttctttcgcaataaaaaaaaaagatgaaggaaaaccttgggaaaggctgtgattttgtacattttattaaccaagcaacataaacttgaattatatcactaagtttatttgctagttactcatttctaagtgtcttacactaataaaaataaaatctcaagtgttttataaaagtaatgggcctagaaaaaattgctgagggtattttttaatatcatctaagttgcttttttcatgcctatggggttaaagaaatgatatgtaagttattaactataatatggccaatgtaattactaccaccaaattaaaacaatcttcaagatgttttaagtatcctaaaatggatgaaaacaccaaaaccccgttaaaaactgatgcttggatggcatagaatgacccttgctatatgaacttctgttctctctccatttcctcctgacagatcatgcttctagagtgaaataaattaaaaacaattttcaattgattgatagctttttaaacacagtgcaccttgaaggaaatcatttacataaagtatttcaagagttacattgctaagttaaaaatcaaagtaaatgaccccaataagagattcctgaatcactaagtaatttcaaataaatgaaaagagaatgaaaggcatttttctcactggatgataagactcctgattaaatcttcttctgacactaaagcaggccttgtagttctaacagctcttcatttcaactaaggtcatcatgaaaagaatgattatcagataaacccaatcagaaaagactcaaaagttttcagagcctccaattccatacgatttctaggcatcctgattgacagttttgtaaaatataaggataattaaactgacatgaaaatcagtaccctgcataaatcctaaaagcagtttatctaaccttttgatcctcagagaactcagtcgtcctagaacctgttcctactcaccatctaatgaaccttcaaaaacagattaacacccaactatcacaccctgtgtagtttacacacataatccatatccccacaatatcattgctctgctcattacacggataatacttcttgctggaactagttcacagcaacttcagtctcttccccaggcataagacaaaactggatggatcttccagaaggaagctttgtgatactgagaaaaaaattaaaattttactcttaaaccataaaccaactgaatattcgacatattaacatagtgttgacaatgtttaaatttcaagtgttttcataacatcaggtagtattttaaagaatgtcaaatcatatacaaagtattaccttatgtaaaatgtgcaatttatttttaaattatcatggaaatatactgttaaaaaataagttagtcatatgagataacactcagctttagatggttttctcccaggtgaaggtgttcagaccatttgtcatgtgtccatttatcattctgcctagtttgaagacaacacacacataccatctttgagtacctgcaactccctctggagaggagtcttttctccaagaccaatggttgtcttagctttcaggatagtcatgccaagattttcacatgaatttcttgtaagactcctggttgtgtaacattttctctctcaaaaatccagaaggaacttttgagtatttgtgccatattaaagcaagaaaggcaaagatccaagtcatataataaacagatcttattaagaagttatgataatataatgagcactatatataaatgtttaattctttaacaactattttttaaagtgatacaaaaaaatatgccatatgtttagaaagctcagcttttattgtcatttccttttcagacatgggattttactttatcttgttctattttaaacaaattatttaggagccacaaatgttttgatgttggaaaatacctatgttaactgccaaaagaaaattaggttatctactagattttcatgcaaaaagtattgagagaaatggccaagttctgctcctaaaaagaaattaccactaaccttgtttctcttccacctttaaaaaaaaaaatctttaaaatgacaaggtaatcacaaattggagttttaaggggcacctgactggcttgtcagactaaagtagcatattaactacactcattgtggcaccatggaagcctcagtttttatcatttcgatatcccctctagggtttcaatcttctctcttggagctcaatcatgctctgtgatgctctgttccatcatgaggatgcaagagaatttctatttaaaaaaacattcagggggaggggggagtggtatcaggcactactgattgagaaggcattccgtgatgatccctattttcagttaaaatgcgcacttacagttttggatttaacacccctgcctttgcagtcagacagtcatttagctggagtcaatcaagcgtatgattagaaataataactcacaagcaatgaattcaaaaagattagatctttgccgaaatgcacaagtacagattcccattatgcatcctttcctctctggtttctagagagcagaccaaaaaacaaacaaacaaaaaaattctcttgcactctaaaagcttgcttcacttaaaatctgactaatcattcttttagctcatgacgagaaacctcagtcagttggagatataatcaacacaaagggaggggtcgctcgtccatcttttcttccctccagttacagcaaaagctgtattttacactgaatgaatgggtcagaagttagacacacacaccttgtttacataaaataagaaagataaatagactatggttaaaacccaaagatacttaatatccaaaacaagaaagaacaattctgcatttataaattattcttcaaattatatttcatttcaagatctggtattatattttaagcagggggttagagagacagaaaaactatgtttggatttaataagtattatattgaaatcagtaacccaagttcaataaaacctttccatgtagcatctttgatgaagtcaataggatttaatttcaataaagaagtttggagaatgaaagcgaattataagattttattttatgtggtactttatctttaatcagagcacatataattcatggtcaagtgtgctaataatgggtagaatgattccaaaggggaaaagattgacaaaaatgataaatgttttgctttagaatataatatagaggggatgggtcgatttgccttcccagctatgcttggtttaggctgcactaccgcagcacacactgatgacactaacataattcatacaaatgatgatagcagagagcagcctgggacttgaaaaatttctgcagataaatcccaaggctgaataaaccacatgtgggtaactgagagctgatgcagtataggaaatatacatgaataaagtccatgcacattctttttaaaaaataataaataaaaagaaagctccagagctgctcgtgtgtgtgtgtatgtgcgtgtgtatgtgtgtctgtgtgtattctggacaaaggaagaaagaaaagagccacatttcagttgctagtagaaagtatcctgtcaattataacaagtatctgaacagtagctatatctgggcagttagcttcatcagtaaaaactcactacaagttgtaatcttacaaaatcacactgtgagaacttttaggagccaatcctttttactcaacaaacaaaaatcacatttttataaatccaaatattaatttgaatgagttcaggtccttttgattacatctgaaaatagccagacctaacatttcattttcttccaggagccaatcaggggatcaatttctactcctttgcctgattgttatgtctaagggcagagagcacattagcagttttgtggaggaaactctgacccacccttaatgtacttttatggaaggatcaccaagaaccaaatctaaaggcttttgcccactgcatatcttcagctttaacacagaaaatattaaccctaattcagcagataccgctactcttatcctaccttaccataaatttaaacccataaaaaaactaaacattacacatacttacatgtgcacatacacacacacacacacacacacacacacagagagagagagagagagagaaagagagagagagagaaccacagagtctccaaatacaggagaaaatggaactggaacagtatttcctactcacttaaccattaattctaggaacattcattcagcaccaaccagatgctggtcactgttttaaaaacctggagagatatcaaagttgatagaatagatttctgcctgttttggggaagtttgctttctaatcagagaagcaggtaaagagtcaccaccagcaccaccacccaatgctcacaacagctttccccgccaccattatctgcaatttcagacatgacaatgaagcgggaaagtaagtaaaataggaagaaaagaaaatgcgtattgagaggcaagtttgcctgaagagtttccacttgttcaaaaggaaataggaagaattaataactattaataatataagtactattcttcttttctaccttctagtgggagaacttgagatgggcaatgcaggatttggactgaagtgctctgttgcggctagagtgaaattcaaatagaagtggaaacacaatacagtttaattttttgcctgataggagggcatctacttaaagtaagtggacctataaaaaactcagattcaaaaatcatgcacttcaagctgggcacagtggtgtgtacctactataacagctactcacgaagcggaggtggggaagactgctagaagcccaggcacaggagaccatcctggacaaaatagcaagacgctgtctctgtttaaaacaaaaaaaatcatggatttcaagaaaaaaaaaagacccagcacacaacctacaatctttcattcattcattatgcaaagattttctgagctcctactatgtaccatgcccattcttggtacaatatctttatgtgcatagtatatatgcaatccaaaatattcagcctgatcagaaattctcctctgtttcttttgaaaaagtaaggccaaagaagaaatatttgaggctttcagtgctaatttgataataaaatcttgatgtatttctgttacttgataatagtaaaaaaatgtgtgagcatgaaattctaaacaaaattcattatatgaacttgtgacattctcatgcactgggttttttttcttccatttccaaacactaattgacagcacttgaaaacagtgattcagcttccgcatgtcatatgattcctagggactgtagctatattcctcaggccagtagactgacaaatcaaaagataagaagtacctctcagcttcaatcaactgaaatgtgtcagaaaatacatttggcataatcttcagaaatgtcagatttggcgatgacaggataggcacagttttcctgacagttttagcacaccaaagtttcagagtccgggttagaatgagaaggaaaataaccacttttgtctgctattttggagaaaacttatacaaaacaagaggaaatctatgacatgccacttgagtctctgactaacatgttataaaatgcctgactgcctaattaatggaatacacaacttgggaaagtgtccactaagattaaaaaggaatgaggtatcttttcatatttttgcttagaaaaccatcctaactccttcttaagggatatacccataatcattcctcttcacattcccaatgtgcctatgccagttgtgtactcttttttttttttattttgagacggagtcttgcactgtcgcccaggctggagtgcagtggtgcgatctcagctcactgcaagctctgcctcccgggttcatgccattctcctgcctcagcctcccgagtagctgggactacaggcacctgacaccacgcctggctaatttcttttttatatttttagtagagacggggtttcgctgtgttagccaggatggtgtctatctcctgacctcgtgatccacccacctcggcctcccaaagtgctgggattacaggtgtgagccaccgcacccggccagttgtgtactcttataaatatgtgtctcatgagtgaagtaaccaacagcattgagagaaactgttgagaaaccaaaatgtaactgaatatattacatagcatacctccacttgaccttgcatgtcatccatgcaagccttgccaaataaaatatttaaaaaatcaaagcaaattaaaatgcaagaaggtaaattctaatctaaatcatgctcctttctgaattctacatcagctggactttctttttttttttttaagacagagtctctctctgttgcccaggctggagtgcagtggtctgatctcagctcactgcaacctctgcctcctgagttcacgcgattctcctgcctcagcctctcaagtagctgggactacaggcatgctaccatacccggctaatttttatatattttttagcagagacggggtttcactatgttggtcaggctggtcttgaactcctggccttgtgatccgcccacctcagcctcccaaagtgctgggattacaggcatgagccaccacgcctagcctatcagctggactttcttctgtctttcagtagcatcacaatccttaggcccccacacacaatcatattctactaattgtgaattacagaaagaacagcttactcgtttctctaagagacagtacacagagctaagacctttgtttctacctctggctacaaaactgtgactcctccaatttcccatttgtaaatagatctccaaaagaaatcagcccgagggcactaaatggctacagatctctgcagaagcactgtaggctgacagtagcaaacctcagtgagcttctcagataggagatacagagtgccttattcagacacttccttccaagccctctaacaactccagctctgtcaaccttcatctgattttcatttataaatgaagttgcacaaatctccaacaataaagaatattgacaaaatctttgttaacatttggcatttctcattttctaaaaaacaaaaacaagattcccatttgggcaactcctaattgtgctggccacgtttcatttactttcaccaccaattcagcagcaatctgtcaatatttgtaccgtaaattaccaaatactctaacttacttatttcaaactgattgtgcatttacatatttatgaacgttatacacagaaagttaagattcatttctcttttgcctaagtctatacatacagtctcccaatgagagaagtaccaagtcagctaaaagagatggttaaaaaatacatttttttctgacttaataatgggttctgtattttcagtattgcttccttttcaagagagcaaattgtttttcactatatttggcaaatgcaacataagataacactgcaaaagacccttattcaatgtattccaagagttaattatttcaggatatgtactctttagtgaatatttcttaagtatgaactaagtgccccctaccatgcataattaagaaaataggatggggtaaaatagagttgaaaagtccctcctattaacttacaggctaaaggaaaaaaatacaggcaaataattacaatataaaataagtactacgataatggagttttatgtgcaaaactttaggtgcaaagaagcaggaataactaatgtgacctgagaactgaagaataaacaggaaccaataaggtggagcagaggagtaagaaaaatccatatttggatcatcacgtgtaagagagtgagaaagaatggaacattagggaagggaaagtaatttgttatgtctagaaagtagtggatgggaggacaatggtaaatattaatatgagaagatggggctagaaggtaaagaatcatcctttaggaaatgtggaacaatccaagaattttaagcaaaagaaagatgtgatcatattcacacttctgaaaggcaactgtggcagacaggcctggcagaagataactttagcagaaacatctaggagaaaacagactggggggctggagtaagagaggacaaagaagcacaaagaagctaccagacaggcccagggttgggaagccggcttctgcttccagccctcagcactggcaagaatccttgcaacagaaagcagcactgggccattctctgcctagaagtggtcattcttcacagtagggatgggtacctcattgaagggcaaaagaaaaataaatgctgagactttcaattttagtctctcaaccaaaaggatccccctaaaacaatgtggcctacttaaagtccagtcaacaaaatttcatatctgattatatgagggaagccatggaacacaaagctgtagaaaacgcattttgagacaggcaaatcctgaatccatctcctggctccacccccctgaggcagctgatcatgagagagctactttccagtttattcttatgtgtaaataggactaatacctaattcacaggtttattatgaggattaaatgagcattaaactagaaaacatgtaattattatcaccatcactattaaataataatggataaaataacgggggatttaaaaagaggaaggaaaagaggatgtcacaggtactattttggtagattttagttgctattaacataaaagaaacaagatgtgagtttggttttagatgagctgttttttaaggtgaaaagagatgggtgttgaagacagaggcatttaaacaggagataatattgtcctcctctatttgactttgccttgatttgatcattttcagaactgtaatgtaaccatgtatcactcttctactttttaactgaatgcataactgccttaagaaaaaaaaaaaagactcaattttataggttatttcccctggcaagtaggtgatcaagtatttaccaatgtgacaagtctaaatatgggacctactagagggagggaacatgttcctcttaattcttttttctatcctgctgcctagaaggtaagtctgatgtctggagcccaagcagccattgtgagccataaggacataaactacatcctaaggaatggcacagtagtgggattctcaactgctttgctaccctagctgcacagaatcacccacgaagcttttaataaaatccccatgtctcaccctcaaatgtcctgactgaattgctgggttggggtcaacatctggatatttgagtatgggtattaaaacctttccaggtgaacaaaaatatgaagctatggttgaaaaatcacacatcattatcatctaatattatttagtatcttattctatcaagacttctgctagaatggcataactagtactaaaagggtaataatggctaccacttactgaatatctccattatgctactatgctcaactccttgcaaatcggtttacctacgttctctaagtcaagccttgtaacaacatcctgatgtcaatattattattttcattttactccttagaaaattcaggtggattgaatttcagtaatagacgtggagtctcaaaagttgaatactcggccgggcgcggtggctcacgcctgtaatcccagcactttaggaggccgaggcgggtggatcatgaggtcaggagatcgagaccatcctggctaacgaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaaaaaagttgaatactcacaagtattcaagcccagaactgactaaatgcaaggcagtcctaaccatcacacagtactgcctccccagatgggttttacttccttttatttcatctagaggtaccagtgaagatgctaatgagcagtgagatggtggggcagggaggagaagaaagaggacacgtaatagttaagattcatctctctgaataatcagtagttaacctgacttcttattaagagtttgcatttgttttcatgcaaatttatctctgatctagatccagaaatgtaccaaatacagtttaaattccaatatatgagaagaagcaccaaatccttacctattttcagcttcctgggttataaatttaaataaatcatgtgaaatacatagaaaaactctttctttcctaatgtttaatgataatttatagccctagaacatttgtaaatttaacagcccatcaaagtgtctgagagcacaccagttctaaggactcattaagtgacattaaacataactttccatgaagtactgtacagcatgaataggtgggcaggctggtgaacagccatcactacaataatttattgtttgtaatttttgccttattacttccaaaaacattttttaaaagaggagggggagattcaaaaaaaaaaaaacaactaccactttgccaatactataaatcacaaaggcagaaagagcttttatgatcctaaggatgtgctaattctttctccagtcacccaaaaaatgacaagaaagaagttttgtggtaaagacttataggattttaaaaattcatttctttgaacagggctgtattgtttctaagtcacctcctccccaaattccaaagattatcagtaaaatgaaactaaagaaaggtagaattttttttccaatacacaagtgggggagtcgcctacttcatccaattcacattcttaaaatagaatttcttttgctctagaaatatgcagagttaagacccgaaataggccttaatctagtatatctggattttacaatatcactaagtgtcaccctagttttgtcagggcattcatcctaccttaataagtaaaatgaggacactaacgatctataattaaaaggtaatattaactcaaaggcaaaagtgacccacagactaagttataatgacaaaagtcaatggctgaagtttagccttccgacctgcataagaaacatccttcacacattttctttaaaacagcccaatcagacagtgaggaacattatacaacattcatggttttcattctttcactacatgatggcagacataatagaattcaaaagttttaactatcagtgcattaagcataatgtaataattatgctgatggcacaatttttactataaagtagatcacttatttggtttaggcttagcctaaaagattgtttttttcctctttttctagacatgtggtccagcacaggtgtctatattcctttgtcaaattctggttatcacttttactaatttggttgactaaaaatattctctccataaacttcaacaacttgatagtgagtatctgcagcagaaatagtcttcctgtataaaagtcatggattaactccacctcaaaagagcagccattttgaaaatgaacccatcaaaatcacaaataaccttagctaattccctttagtgttcttatgctaagtaacaacatatataatagtcccaaaaaaatttgtgtctagtatatgtgaggtattcattgtttacctttaaaacctcctttctgaacaacattaagagaaaacaatacggttttcacaaaaattatattttatatataaacattcatttaccaactacttaatacaatttcagccaaacaaaaatagcttcagtaatttgtactgggttaactttaacattcctgtagctttctgtgtttttatccagcatgcatgcacaatgctggccttaacgcaattcaaaatgtgaacatgtaaatatgtctgagagatttattaattgaaagtagcggaaactcaccaaaataacttccaaacttacgctgtagcaactaatttttgaaatactatgcagagctaataaagaaggaaactttttaaaatttttatttctgaatagccattggtttgactcaactgagaaaatttcattggctgttttgacattaggtggccagctggtatatactctaatttcacaggtgaggtttttgagattgtctatgcattcttatatgcagctaccaccaataagtaagaaagaatgattattgaattcaatcaccaatttctcccaatatatatgtacaaagcagaacaaagaaaaataaaaaaaaaatcaccagcaggcagcatgccttgttgattattttcccatcactaataacaatttatataaactacaaaacatgttataatttgaagcaatttattcacatctaaaattattactctaattccttattaattggtgttaagtaagaattaccagattattccaaagctaatattgcataacagcaagcagaaacaggtttagcaatcatctaaaattagcttattcactggaaaataaagattgaatgttaaggtataaaattattctaaatccccaaacacaccagaaccaattgtgaaattaaaatatgacactttccataattcaaactacagtacttgattttcatctttctcctcagctacccctaaattaaattagtcttattgattataactcagaaatccctgtcttgttactatgattttcaaattttaatgaaatgtacaatttagttgaacatagttaagttggttttcttaaattacaatatagaagattaagtataggctcaacaaatctcctcattactatagctacagacacattgaaagccaattcctttgcttgcttatgacaactgataaattcatgcattacaaacctgttttcaagtctgtcatgacagatgatcactcactgaagtaagatcttatgaactgattatcagtgttatttaatgaagcactggctgcacctaggtactggagtgaaatagaagtcctagtccaattaaaatgtggtgctgtgtacaaatggttgttaataactttagtaaatgcagaaccaccatttgaaattcacaagtcatcatcctagcaaacagaatagtacacagtatgtcttctttttttttcttactatttttttgagacaagttcttactctggctctatcacccagagtggagtgaagtagcgcagccatagctcactgtaacctcaaactcctgagctcaaaggatcttcctcccttaggtagtagctaggactataggtacacaccaccacacctggctaattaatttaaaaaaaattttttttagagatgggatatctctatgttgcccagactggtctcaaactcctggcctccagcaatcctcccacctcacctcccaaagccctgggactgcaagcatgagccaccatgcccagctatattttctgtaaattgctaatgagaatgaaacatgtatgctgtggacagaagccttgttggacctagcgcccatgctgggtcctttgccttaataaaacataactctggcattacatatataattaacagcctcaaagaacatgtttctttattaaactctgactgtttcagcattattttcagtacatttagatttaagtttggttttgattttttttaacttaagtgaaaagtatttctttcttatcagcatttctttgactttcacagttggtggtgccctgagcaaaaatgaatggatgcctagaccaccccagaccattcctccttcctccccaaaccaaagctgtggaactaactcttaactgtcttatttgtaaacagtggctgtattcatggctaatattgtaagattttctgtgtagtatcatcaaatttaataattccttaacaggaactgttcattaagggttgctttctattaaaaaataggtatgtgctaccttttcaatcttcttctcataatatttgagtgatttatttccattttgaatctttctgtttgttaactttggtgaaattaatatactattactaaaaaagcacattagagtaactggatgaatgacttgagctctcagctctcttcatcccaacaaatggggatgaaacattcattttcttcacatagatataataaatgttatcagccagtttctcacctgaggaattgttactgagggagtgctgagcatacaaattcctatatcagaactatcttctttctcaacaaaatgcaaggcaagtcttcattaactactgcctggtcatttacaacacacaccaaaaataaatgaggatgctatttaagataagaatacaataatgtttaaagagtattaagccacatcagatgcggtggcacgggcctgtagtcccagctactcaggaggctgaagctggaggactgcttgagcccaggagttcgaggttgctgtgagctatgattgtgccattgcactccaacctgggtgacagatcaagaccacatctcaaaaaaaaaaaaaaaaaaaaaggaaaaggagtattaagccattgtcataagtcactaattctcagctgtaaatatacttaaatatatttaagtgtaatctttcatttgttgaatcatgtattttatatttgatgaatttccatttcaattaccacaatgatgtttacacaagttgcaaacatttgtttttactagaagagactaagtcctattcattagcattgctcactgtcaattatgaaatacatttattatctccatcagagctatacgatacttagtttcaaaatacatgtcattactcaatgagaatgaattaaaataaagcatcaagattaactaggctagatctatagtaatatatcattcaaataataaaaattaatgcttattaatttcttactgcatgccatgtacagtactaagcacttcacatataataactcaatgtcatccataaaataacactgtgagataggtattgttatcatatctattttacagataggaataacgatgcaccaagaaggtaaagaacttgattaagactacacagctagtggaagataattgcttctaaagcttatgttctaacatctaaaataagccagttatgtcatgatgcctcttaagaagtctcatatgaatcaaatgctctatattaccagcacctggagaactttaattttaaaaataaataggcttattaagttacacatattgtaatactttagacagttcctgttagacatagcctaaaaatatattatagcatataaaatgaaactcaaaacaaaaagtacctagaattaatattttgctccactttccccaatccattcattatgaaaatttgtcactaagtatatagaacattggaagtgggtttttttgttactgtttcctatttagactataagctagacatagtctagaaaagtagctaatctatacattattgaaaataccacaacatattataccaggggaaccatagataaatactaaatattacattgataatgagtaatgggctgaaagcaaaactacaatgtaactcaaagagggaatatgaagccaaaataaaatggatgtgaatcccatgcaagctgtcccttagtcttctgaaggctgtgaaaagagaaggccttatttaggacaaagaaaggtagtatttttgaggtctggggaagatgctgatatcacttctgttcattattacaatactaaaaacaagtcatataaggagacgaagaagaaaggatggacaaactatctcatataatcattgtattttctgcaaatacagaaaataaatggtaagagctctattttatctgaaactgtagtttcttcggcatcctaagtgattttcctaaagtgtcatttatttgtctctagtgaaaggaaggaaagaatgttcaaaggcatagaatgtttttaatctctacctttgaacttccattatattgtttaaaaattactacgtgcatgtattacctattagtttaataaaactaacattttaagtgtcagtctacacacacaaaaaattcatcaaacccaatttaaagttagttatttaaaatattaataaatgattactaaatgattctaaatattctacatttaaagcaattacccaaggagaaaaatatgaaactgtatttaaaaaatacattaagccctgtcctttccatatatatgttaatggaatacaaacaggcacacacacacacattgcattttgggggcaatcaagctactctgtatgatactataatagtggaatacatgtcatcatacatttatccaaacccatacaatgtacaccaccaagagggaaacctaatgtaaactgtagactttgggtgacaatgatatgtcagtgtaggttcatcaattgtaacaaacgtaccactgtggtgagggatgttgataatgggagaagctgtgcacctgtggcagcagggagtatatgggaaatctctgtaccttctgttcaattttgctgcaaatctaaaaatgctcataactaaagttgtccaacctatggcccacaggccacatgtggcccaggatggctttgaatacagcccaacacaaatctgtaaactttcttaaaacattatgagatgtggctaggcatggtggctcatgcctgtaatcccagcactttgggaggctgagaagggtggatcatttgaggtaaggagtttgagaacagcctggccaacatggtgataccccgcttctactaaaagcacaacattagccgggcatggaggcacacacctgtaatccccgctaccagggaggctgaggcgggagaatctcttgaacctgggaggcggaggttgcagtgagccgagatggcaccactgcactccaggctgagcaacaaagcgtgactccatctcaaaaaaaaaaaaagaaaaaaaaattacgagattgttttgcaatttttttaaagctcatcagctatcattagtgttagtgtattttatgtgtgacccaagacaattcttccaatgtggccagggaaggcaaaagatggaacaccctgctctaaactatagtctgtttaataaaaaatcatgtgtcatttaatgaaggagaaatgttctgagaaatcattaggtgattttaccactgtgtgaaagtcatacagtgtacttacacagacctagattgtatagcctactacacacctaggctatatggtatagcctattgcttctaagctacaaacctgtatagcaagttcctgttctgaacactgtaggcaattgtgacacaatggtaaatatttgcatatctaaatgtatctaaacatagaaaaggcacagtaaaattatgttataaaaagattaaaaaatggtacacctatatagaacattaccatgaatggagcttgtggaactggaagttgctctcggtgagtcggtgagtgagtggtgactgaatatgaagacccagctctgtacacttctgtagactttatgaacactggacactgaagctacactaaatttattaaaaatattttttcttcaataatagattaaccttagcttactgtaactttttactttataaacttttcatttaaccttttgactcttttgtaataccacttagcttgaaacacaaatacattgtacaactgtacaaagtattttctttatatcctctctatcagctttttcatgaaaatttatttttttactttttaaacttttgttaaaaacgaagacataaactcacatatcagcctaggcctccacagggtgagaaatatcaatatcactgtcttccccctccacatcttgtcctgctgaaaagtcttcaggagcaataacacacacagaactgtcacctcctatggtaacaacgttttcttctggaataccttctcaaggacctgcctgaggctgttttgcagttaactttttttatatgtgagtacaaagattatactcaaaaataatgataagaagtacagtacagtaagtactaggcaataggcatttttcagctccattataatcttatggggccaccattataaatgtagtcctttgttgactaaaaacattgttacatagggcctgactacaaacacacacacacacacacacacacacacacacactctctgtctctctcatatgccctgtccttttcatatatatggaatatttttacacatatatatgaatgtacatttatacacatgtacatatatatatatatacatgtgtctttcatatatatacatatacacaaacacacacaatatacaaattttgcctatggtaaaactaaaagagtatccttgtagacactcattgagcaaatagtttttctggataccaaaaaattattgttttatatgaaaatacaagaacaactcttcccataaaacactgatggatatgaaataagtaatttctttatataattgtataatttttgagatgtagacatgtttattttcctacaaaaaacataaatatttataccttattaaattatctttatagcataaaatattctgatcattttcaatttaaaaaagcattgacataaagtattaattttctcctagaaagaaaatgggaggggggaaataaagttatcagaatagtttatcaaggctttagttgaggtctgctttctcaaagtaatacatatatttggatgttttgtatttatatgcaatttattaggtttcaatttgatttttttcactgctgcatcacaggatggttgctggtttagaaaggaagcaagtaggccagccacccaaaaagaaaccctcgctgtacctcccaggagattcttgcaacagacagatgctggccacacttcacagccttccagccaccagttgcccagcacatggctgagagggaagaacgagccagtaatggcaggcaccagcattttataaacaactggttctctaattccttctcatctctctcttttctctttacttacctctctcccgtctcctttcctttctctcttctcaacagccttgccatttcccccatctttatctcactattcttacttcattcttattcctttctcctttttctcctcacttgctttccgctgctcccttttccagtcttttttcctctcctccaacatattttatttgtaaattgcatccatccacaaaaactctgatatacttataagaacacataaaaaaattataacacgttagcaaaattccaacaaggaatagtgtggatacattaggtaagcaagactcacaaatactggacctttcatcattctctttactatacctccaatcccccatcttgtcaactatttacttttttactctttaacatactgttatctaccttctcatctattctcccctccagcatcctttccccgtcttccttgttcttctcttcatctttattattctagttcaagaacatcctttcagtaaccaagtgctccacaacctgtcccttcaaatgtaaacaaaatctcaccaaattttacccagagaaattttgttttctcccatctccttgcctctccttagcaagcctataacagaaaattcagaggctgtgtctcaaacactctccttatgcatatcaaactttttaactattataggagatctccaatataattgctgaggatattctttgaaaatattttcctaatctactaatgcaccccaaaatatttacgttttaaaattatccttttgaaataactccaccaagattgcattgtagaattcaccttataattcagtattttacttttctttctatgcctttaatctgcactaaactaattctggttacaagggcacttttgtgtacaatgcagatttttttttatttcttgctttccaataaatgacacacagagatataacaagagggaagtccttcagtagtctaaattgaggtcattttttaaaatgcattctgctttttaaaaatttcttcctgctttcattatttgtgagtcatttgttatccttaataccaatggggtcaagactcatggtcctttcccgaagtgaactactcctccaaaaacattatgaatgtgtttttcatgatgaattacaagtaagccagccagttctactcaagagccaggatgagacatgcaattaggctgtaaaaacccgatgtgctctttccacctttcctgtccctttcagcatggacaaagcaagaagggaaaagtctcctgacaagatgccaagtaagcccaggcccttctgaggcatcctggcggtagccagcagcagcccatctctgcattgccctcactgccggggccccgcgcctcatggcactgctgcgtcacattacttccgcttttctaacttttccacttgtgagcaccatcaattatgcactagaataacaggggctggccaggcagtgtaacataaaggccgattatgatgataaataatttaaacacctgcgtgccatgttccttttatcagtgacaggaggccaggggaatgtgatgcacaatgaaggtctgaatgtcccagaatgaccaatttggggacagcagggagcacattcacccatgaacctcctgttcactgcccacagggaggaaaggggcaaactgaatgaactgttcacaaacgtattcacacttgaaaaaactagctaagaatcacaggccacagatccaaagaacttttctttctttcttttatttttggccctagatctagcccaggaagtgcagggaacaatattttagcagtgggtggcatcttatatcttccagaaaaaaaagggaaacaattccatacaaaaagattttaagagaaaagacatagtttcatgtaaagttattcagactttaacaaaattcagacttgatgatctctttaccacacagtatgtttaatggtaaagtgtaattgggagctggcaggggataacagatacagtagaggtgaccggtctaacccccttttaaatgacacctcaccatttctcaactgtgatgcagaaattcttcaagtctctttattagtatcctatttttttaattgtgatttgaaaattcataatggtgtctcactcgtgtaatccaagcactttggaaggccaagctgggaggtttgcatagaggctaggaattcgagaccagcctgtgcaacctagagagaccttgtctctacaaaagattagaaaattagctgggcatggtggtatgcatctgtggtcctagttacttaggaggctgaggtggaagatcacttgagcccaggtgtttgaggttgcagttagctatgatggcgccactgcactgtagcctggacaacaaatgagatcctctcacaaaaaaagaagaaagttcacaacaaagaggaaactttcatatgttcaaaaacttccaggaaaacaggtaccctcctaccaacgccctggggagttcaaaactcagtaacactgacagtatctgatatcaggtggatgttctttacccacataggcagactaagttttaacctgagtccttaagggcgtatacccacaccaaaaataatgacagtatttcaaatgggagaagttcagataactgtctcaagtctattgatcttcatggagataatttccaaggtataatgcaagatttctaatgtttaaaaaaggtagaacaaccccaatagcatatacaagagtgaaagggaaaggaataaaactagataccagtaaggatgttgacaaatcaaaaagtgaccttaaaatatacgaaattcaaaagaaacgcatttaacttacgtcaaatgatagtcaacttcacttctggaatgagacttccattatctagaaatattccaaaattaattcttagtctacatgagagctaatattacatttctaaatgcaaattgatgaaaactctagggggaaaaaccattttgaactgtggtttccagaaggcttcaggtttagtcatgtcaaattaaagcggagcaaagcttcttaaaataacattcttcttaaatcgcatccatatgatttagcaaattgatacggccaaagtcaataaatcatgatgccgggtttttactttaatgtataactgcttttattttattttttgctttgagccaactccttataatttttagcccaaagttaaatgtatattcttgtctaggcaaaacaagctacttctcacataacgggttcctggttttcaatgtcaaaccaccacgaatgaaggaaatcttcccccagcggttcagcaggacacagagctggctgcctctggttgcaccaacatgcaacccattaactgcttttcagttggcagtatttgaatttgtagattttttcaccacttttcaatgtgtaagtgcttcttttttcttaaccccagggatttcattttgtgctgacacatacccaagaagcaatctccatgaaactatccttttaaggcaagcattttgtgcactccttaatgatgggtgtttaagagaaatggtaattatgatagattttgagccttaggtaacagacagcctcacagtgagagggttcactacatttaagaccaaactcctcattaagaaatggagatgtatcaattcagctctgtgcagacacactgacagtgaagtccaggttagtaaaagcattcatccttaggatggatggtctcaggagtgagccaacattcaacaaggtcatgctagttcacccagattgtgggcaaatgaaacttctcagggacagttaaacctaagggacatgggttgaaaatattattaaagcatcaatgcttaaaatattttctcctttcttatcctttttatgactttaaaatatttttgtttaaatgagtcacttaagctaccacattagatattctgcatgctataactgatgctgaaatcagagtatcagacaaaaggcatctaaagttcttaactaatgctagtaataaaactaccatgaaaacatattttatatatgtgtgtgtacataaatctgttttgcatatatgtgtgtgactcctaagactctcctcaagaggtattccagattaacatcactgttaaatgagaaaaaaaaagtccttgaatcaagatgcataacttcaatcccctccccacacgctgcatatgcgtgcaaaagttttcctgcccagcttgcctgcaaggatggcgaacagaatttaatatttcatggagcccaaagcacaaagcatgttcaaattcaatacaagaaaatgctttatcacatcctttatagattaataatccaaaacggtgagaaacttcaggaagccatgacaagttttaaccaaatgacatgtaagtttcttctggacaccctcaagctattaatgaaacagaaaatctgaaagatgtgtttgatttatctgtttaaggtatgtatttccagaagagttaccatatcccatcatattatttattatagctaacataacttggaatatcttatgcagtttttcttcaagaagatcagatcatgttcttgaatacagatggcataagccacgtatcttgcataacacttcctctattaaagctaaacccatgaaaactgtttaaagggaaagagtgaaacatgggcaaacatggtcccataataaccagctgtgaaggtgataaggttctggcagggcagtggcgtgatgacacagggcaataatctgtaaaccattagaaacgagcatgaaaagtatttagtgttttacaaatatttcagagcaaagcaagcatttcaggtttaaatcaaccagatttaagctttctggttttataagaataacctactataaatctttctaaaatgtgcctgctttttgtttatttaattttattcaggccagtaatgaccatgacaaatacctaaatgctgaactaagcaagaattctaaccctaaattttgtgtgggaggcttaaatttcttttataaagccaatgacagtaaatgagttcattattggtcactttcttttgataaaccataaccaaaaataaaatcgtaatataattataagagaaatcaaaagtccagaaaaaacaagagtacagccatatcttctccaatctttaatccactcccaagaatgacttttggttaaaataagtcatttcaatctataatatttagaatgacaagagaagtcctttgactccagcctgcttccagcatctgtcaagaaaatcacaaacctaaccctcaattcattggagaatgctaacaggagatgaataaggcttcagagagagaaagcatattattagaaaggttcaagaccaaatattcacagcaaggcactgtgtgtgtgtgtgtgtgtgtctgtgtgtgtgtgtgtgtgtgtgtgggtttgcttttcaagtatggtactgagtttttaaagtatatggattaggttatttttagttgaaatttttcaaaataaaagatacatatagtgtatgtgtgtgtgtatatatacataaactgattatatatatactatatataatcagtttaaatttaaaagcccctacagattatatataatatataatttatgattatacataatatataatcacatatgtaataatatatataatcagtttaaattcaaaagcccctacagagaaaacaaaaaactaagctaacagtttatttttatttatttatttatttatttatttttgacggagtctcactctgtcgcccaggctggagtgcagtggcactatctcggctaactgcaagctccgcctcctgggttcatgccattctcctgcctcagcctcccaagtagctgggactacacgcacctgccaccacgcctggctaattttttgtattttttttttttagtagagacggggtttcaccatgttagccaggatggtctcgatctcctgacctcatgatccgtccaccttggcctctcaaagtgctgggattacaggcttgagccatcgtgcccggccaacagtttacttttttagtccacttttgcatttcaactacttctaatcatagataacctaagggttcctgctttccaatccacacaagaaatcttatcagagatacaacaccgcgtgatctcacttatatgcagaggctaaaaaagtagaactcatagagagagagtaaaaagatggtttccagggactggggcgggtgggtgaagaaagtagagagatgttagtcaaagaacacaaaatttcagttaagtgaaataagttcaagagatctattatacaacatggtggctacagctaataacaatacattgtatagagttgacctactgcaaccacaaattcaaacaggcatggatcaaaaatatttttaaaaaagtaagatataacaatacaaaaatgcaaaatttaaaatacagtatgacaactatttacatagcatctatgttgtattaggtattataagtaacctggggatgatctagattatacagaaggatgtgcatatgttatatgcaaacatgataccatttcaattttatataagggacttgaccatctgaggactttggtatccatagagtttctggaaacaatcctccacggataccgagggatgaatgtacttcaaaatttctaacagaatagatcttaagcgttctcactatacacacacatacacacacacatatacacacacaaaaaaataagtatgtgaactaatgcatatgttaaatagcttgctttagccattctacaatgtatacatacatcaaaacattgtaaaccataaatacatagtttttacttgtcaattaaaataaatggatttaataaaatagaaaaaagatacatgtggtgtgttgcagaatactgtaaaagcatatagaaagcactcaggtagtaaaaattcagccttcagttataaaagcgtttcatttaaaacacaacatattacttcggtgatttaacattttcccatttttctctatcccatacccaccacacacagaataacctacataagttagaattttaaaatggggggttattatttacattttctagaatacaactaatttggaaaaagtcagaggagcagcagtgaattggcagcattcatttggtaaattcggtaagatgacatatacctgcttaaacaatagtgctagcagcagaagctcagtgaagtgcttaagagcacagactctggaaccaacttccacggttcataattccaattctgtcacttactaaaggtgtaactttcatccaataatctctcaatgccttggtatccttaactgcaaaatgaagatggcagtaatagtacctacctcatagggtcattaggcaaattacatgactttacatatgcacagtgcttgaaaagagactgacacatgggaagtgctatgtaatttttatttgtttatcttaaggctattgtgcagactataaatgtattaagtgcccagcacagggctcaactcagcagtgtggtagctggtagtagtattttttttctaatggcataggttaataagagcaagcgttaccaattattagtgcctttgtaaacagtaaacaaataagcctccatttcattatcaaacaaatgtctattaaaacacattttttgtttcttaaaaaaaacccagtgccagtaagagtgtaatgaaactataaaccgacaatattactaagaattataccatgttaatagtttgatcccataatcctaatactgcaccctagagatatactaaaatataagaaaagctttaagccaaaaaaattgtttaagttatttatgtgtcacttatgaaaaactgaaaacaatataggtgtctaacaataaggaacagtaggtcagtatttgaaaataggaggtttgggatatgcctcatataactagatttctccatcttggtctgtcagtggttattaatatatcaaagatactgagaggctgagacttaacgccattttttaatctgcatttcccagacacactgggtaacggaaactttgggggaaggtggtttcccattgaactaaagtgcccaggaacaggatggctaatctcgatgataatatatgcagcccttgacaaggatagttttcagtatcattcagcctgcttccagaagtatgagaagaatactcattatatcaatgttaagagaaaaaaaaaggctagactcagtcaattaatagctaagcatatgagaaaagctcaaatcccaaaatgatttgtagaattatgtgtaaatgttattttaatgtgaagctacttctatagtgaaaacaagttcataatcgtgacattataaaaccaatgtgatttagtgatagcaagtcttctgtcttcctgatttggaagtacagtttgtttatctggttactttaataaggcctgaggggcgaatccttactgaaagtgaccagtaacaagaacacagaaaacaaacagagagatcattcagcttcaccagaggaatacatggaggcagccagccctgtcaatttggaagaggctaatgaaacattatctgcaggtgagcggactgtcttgcagtattacagctctaagctacaaatgctttcctaaccacagaggtaaccgctatacagatactttgaaagacaaatgagaatgctgccacatgcaaggtcaatcacaaacaacctgggtgtctctccttccccaggagaccaggacctagggagccagtgggtatacccaagcaggccacaccaggtcacttctcttacatttctgagtttcaattttagcaacctggtaggtaggtaggtaggcaggtagatagatagatagatagatagatagatagatagatagatagatagacagacagacagacagatagatagatagaatgtatggatatgattaaaaataggctgggcacggtggctcacacctgtaatcccagcactttgggaggccaaggcaggtggattgcttgaggtcaggagttcgagaccagcctgggcaacatggtgaaacccatctctactaaaaatacaaaaaattagctgggcatggtggtacgtgcctgtagtcccagctactcgggaggctgaggagcaggaatcacttgaacccaggaggcaaaggttacagtgagcagagactgtaccaccgcactccagcctgggcaacagagtgagactctgtctcaaaaaaaaaaaaaatgtagaaataaagctcacacacattctggaaactgcttttccttgtgtcggagaaaatgagtaatcatcaatttccagtgcttataattttctgattaaggttactatggtttcaggaaatcactgtatgcacaagagcatggtaggctgtggactacctacaggggagaaaaataaaatcctagtaaataatagacagttcacttttgtctaggaagtttattaatacatcaactcccaaggtattctgggatgatgattttatttgatgcaatacattctatttaaggattttctttttatgacctaatgatgcatttaatttttaattaaatttcattttaaagtataaatatgtataaaagccaaagcaagtgtacagcatctgttcattgcatctgcactcactaccacaaaaattagccttaatctaaagaggcacaaatgggtttttataccaacaggaggcccaagtatttaaaaatcaatgactgtccacccagacaaagaacagctgtttcctatattccagctccatatcaagcccatgctcaacccaatggctagcctaaaactgcccatactctcgttttccccagtcaaaactgtcaaaaaagggcagtatctaaaagccatgagctggattaagtggagacaaggcagagaaggcctggcccaaacagatggcattttaagagacaccctctatcaccatcattcaatgacttagtaaaatcataatcaatcttatttcctgtgttcccaaatctacttaatgagacatttcacttttgtttaaaaggccaaggaggggactgtagggattggagagattttggtcaaaggacacaaactttcccttagacagaaggaataagttcaagagatctattgtgcattatagtggctatagttaataatatattgtatacttcaaaattgctgagagcagatttcaagggttctcaccacaaaaaataagtatgtgaagtaatgcatgttaaatagcttgatttagccattccatgatgtatacacatatatcaaaatatcattttgtagaccatagatatatacaatttttgtcaactaaaaaaaaaaaaaaaaaagccaaggaatgtcaagagtgaatcgatcgattctcaaccctccaaaacaagacttctttccctggaacgcaagtgagttctaaaatatttcatagactggagaatatcaccacttaatcaccacttaattgggcagttatagcattctctaaaatatgtgtgtttttactttcctgaaggacatgaaaccaagatggtagaagatggtatgaggagagaagaaaaagtaaaatgttcgcaaaatggagagaaagaaagaatacggggagtggtcatggtttttaaaggaagctccttggcactaggattttctattaagtcttttagggatcactttaaacagagttccatggtggagagtaggaagaagaaaaatcttagaaattatagatgagaagacagatttgtgttttgtgtgtcatctaaaatgtcattttgtccatttcctcacctgaaaaaaaaaaaaaaaactaatctagacgatcttgaaggccccatgtggtaccatgtttatatacttttcctgattgagtctcagaactaaattttaaaaggcatatattgagacaaatcagtaggtaatataagaaaactattaggagggcctcaaaaaacaacaggaggcaacagcacatttctcttctaacacggatgcccctgcaccggctgacttagtcctttaaataactcctaagtagatctaacaaatgaaatcagaatcttgccatgctagtgcccccattgtgcaggggtgggggtcccatcataggggttctgataagcactggactgtatggactttagtggtagcaattctggctggtcatagattcaaatccaaccatttacaggaggatttgtgggttgtgagtcaagtgggttgagaaatcataggaagcaccctctattgactgcacagaaacccatccctctattgattgcttcctgatcattcaggcccgtggacaccctgcttcagtgatctgccatctgcagcacatcctggggtgctctccagacacaaccatctgggcccccaaaagggtcccatggtcccagcctgaaaggtgattgtctccagaagcaccttcactgtgtttcaagcatcagggcttattaaaaccccgaagggaagtaatccctgaatgccactaaaagatctccagctggtaccatttatgaagtaagcttgacgagagggggagtgaatgggggagtggggacaggaaggaccagaagagagaagaatttagacaagggcaagttatccaaagagagcccccatcaaaaaagagtcatgttttatcagcttaagctttcctgccttctttcccaaaggtatttcccccctcaactctcattaattcttctttatagctgtctattttctttaataataataataataataataataataaaggcagcacatggctagagaaagtctgtgtgtgaaaattagaaagacttttcggatgaattacctggaaacaactgaacatgtcttccctagaaaatcagggaggaaaatgtttttttcatggaaaagaattagagtagctctcagtatctgtctctcccttctccattctttgggaaaagtcttttcatctcattaagttaagctgattaataaaaattcagcagtttgcccatggatcctttagaagtggcgatacaagctgaaagatgcaggcggaaggtttttgtgctggagacaatacaggggatgacttcttaaatccgtcgtcgtcatcctccattagtgataaatagtcaccttggctcagattcgtcagacaaatactatattgctacttgttatcttctagtaaccttcagaaaaactttagtgtttacttaaaaaatgaggaaaaaaaagaatcattatgtagaaaaaaatgagaacattttgcttcgtttcaaaaattatttattcaaattagtgaacaaaacatggtctatcggaataggctcattaaacagaaaaaatacttgcatccaaagaaatctcatatgtaaatagaaacttgtatattttttgctgtaacaagcagacaaatccagttattttttcatgaataactgtttattttgtcatcaaaaaatctttgttaattacctagttggtaactgacacataatagatgctcaatcaagagtttaagaagtgaatttcctcaacaaattttaagtgactactgtctacttttttctgttttgttttttgtttgtttttttgagacagtcttgccctgccacccagtttggagtgcaatggtgcaatctcggctcactgcaacctccgtctcctgggttcaagcaattctgctgcctcagcctcctgagtagctgggattacaggcatgtgccacaatacctggctaattttgtatttttagtagagatggggtttctccaggttggtcaggccggtctcgaactcccaacctcaagtgatctgcccacctcagcctctcaaagtgctgggattacaggcgtgagccaccacgcctggcctgttctgtttttcaaattttaagttctgggatacatgtgtaggatgtgcagggtttttaggtaaacatgtgccatggtggtttgctgcacctatcaatccatcacctaggtattaagccccacatgcattagttatttagagtcaattatataatgccatgacttacaaatgtcttcagctatccagacatgggttaaatacatccagaaaatatatatctattatgtgaaaagcttcaaacaaggggacataaagatcagtaaatctgccttgtagaagttgaagtaatttccgggctacctttaaacttgtgtagcactaaactgttcacctgtattttatccaaagtatttttcccaactgaccgaattaaatttgtactacccttcataatttgtttaaaagtccttgtaagtggcattcactattcacatgttaataactctgccaaatttatatctagcaaatcttggtatgtataagagtgtttttagtgccatttaaaccaatttattcacactatactgaatcaagttttatagtcaatctagtcattaaatttaccctaaaacaccagaacaaataaatatttttgtctgattctcacttcagaaagattgggcaggggtagttcttttcattcacatcttatggatattacatatacttaaagtcatgaattctttacagaacagcccccaaatgtttaaaagtgttaggcatgtttaaagatgcaactcttgatttggagattgctaaaacaacaataaaagacttattctaaaccttgatcaaattagctacttagctattattgttttctccagataaatatggattcagtaccagtaatagagccaaactcatttgaccacatattccctgtggcctgaagccgtcacctgttttgccatcgtcaatctatcttttcaaatacctaagaggctgagaccaatgcagctgagagaaacaatggataaggatctatttacacttctgctgtgaagaataatcataggttagctctggcttccaattaacaaataaaaaattggttaactaaagcacagctctttttctgtgaaatgataggtgagcagaatctaacagacactatatgcttagtaattagtatctaaggtataggaaaagagtacgcagttgcagtctagagatggaatgtacagcatgatgactatagttagtaatattgtgttgtatactgaaagtatgctaaaagggatagattggataaactgacttccttgactatggtaattatttcactctgtatatcaaaacatgatatacatatatcatggtgtacatgtcgtacatcttatatacaaaatatttttgaaaaatttaaagatactatatgcttaaaggcattatcattctcatattttaaaaattctacaacatgcctactgtgtgccaagcactatgttgactactgtaaacaaaaagaaaccaagtagattataagtatctggtattaatgtccagtgaggtgagataaatattactgagggatagtaaagggtaatactgattaaacatgttggtactagttcttccttttacaaatctacttgagttcctggatctccctgtaaacactgagacagaaagggtcacacatattgactcattttgtgcatatcttattgaaatgggaagctgttgagaaaacattcaactgcttctgaaaaaaatatttacatggtgagggggatacttctacttactatcagtgggtactatcactgaaagtggttcttaatatagaatgtccttgaccacaaataaatttttttaaagcttatttaaaaagcttcattgtatgggattttcctgtatgagaaaagtacagacatttgggtcagttctctaagtttctccagaaatagtattttattatatatattccactgaaattgagacttttgaatatgactgtcagtacattgtaggcaactattaagcatattttaaataacatatcaaagacaattatgaaatgcataaagcccctataatgcaaaattttttcaaaaatagcatctctgtgatgttatcaccctgacaatataaaacacaagaaaatgaaatatagttgataagattatgtaaaatgcagtatatgtatgtatttaagtaaaatgatttattttgcatcttaacaaaatatcaacctatttctatcatattcaattctggaaatttaagagccagacaagcaaacttcttggtgtaaatatgtagctactatatacactttcttcagcatctcacaatgcatcgtgggtataactgtctacaataaattaacagtaactcaatatttataaaagagaaacatagttcaaaatcatagccccataactggcattgcaattataatgagctcttattttatgaatatctttcaatgaaaatagctatattggtaactggaaataattattagtaaaacagacctactttaatgctcattctgataatcaaaaaatttaagattacagaattataaaataatggagaggaataaaatagattccacaaaagttcaacttggattaagttaagttgaacagcttttattagataacaaggaaatgaaaaacattcagttcatgtccaacaaattactaaatgcagaaacaccagcaaacacacattttactgtcggtaatggctgctgctcacaaatcaatctacttggatgagaacaagcctaacctctaagaggacacatcactgtgctctgtgactgtgattagtccaccgaaaactcacactgtcacaggaaatggggtgaatccagtccaatttacccatgaaactgattaggaataatttgactagaaactgcagagaaaacagaccctgagtgggccaggcaactccaataaatgaggtctataagcaaagctgtccaaagcaagaagggcattaaacaggtggattagataatatttaggcatttctgtttatatatctatttctatacttaccatcatcttgatgcaaacgcatttagtaacttacttaaagtttcactgaaaaaaagtttaactgattttttgcctaaatcattcttgcaaagagaactggcatcttggaacttactttaaagaaccaacatgtcttattcacttaggttctcactgattattaaagcaagttttgaaaagttcatttcatattataaagtttactatgacattatttatatatttttaataatcacatgaaagatatgtataaaattagttgagctttgtcaaaacatgcaataaaagggtgtgacaatggagtcatatttatgtaactaaaatacttatattgcataattgtttgctgaattaaaatactatatacaagtacccaatgtttaaaaattcttattctacttcttacttccttccaaatgcaaagggaaaacaaatgaaaaccaaatagtttcaacttgtggtacattttatagctgtgaattgaaaacattttattctaggctcttctttttcttcttttgaagcacttagattttttaaaaccatttttaattcttagaattagtctaaattaagagtttactcagatacagcacagttgcgatctccctgcgtcaaacttcaggattcaactcatcaactctgataagggatgttggatggtttgggtagttgaatatatgtcacacattatttttattactgactaattgtaacttcagtgtggttttccagatataaatatttaaagccatgtctgaaaacaaaacagaaaaaaaaatccttttaataaaatctttagagtcatgtttgaaagtaaaaaagaaaacttctgtgtcctcttcaaaagtttacacaatgtaaatatgtatgtattagttcctcttaactgaaaaaacaaagttggagggttggggagaagtaaatcataagtttttaaaaaagaagttttaaaggctgatagattaatgaagttgaaaatgacctcccagaagacaacaatcccctcatttcacagatgaggaaacacgacttgaccaaggttaagtgacttgcccaaggtcaaacagttaaatagtgtcaaggccttaccacatctcggatcttctaagtgagatgctctcgcctaagagatcgactaattcaatcaccttgtaaagatgaaaaacagagtcccagagcaatcgatgacttgattaaggtaaacatctagttggtagaaaataaaaaacctgactccaggccttggtatttttttaaaagatattttttcatcttccaaactgataaaatcaaaaagaataattttctcacaaatcaatacatgaatttagttaggctggcaaaacatctggcaacaggtagccaataaattgaaatgaagagaggcacactatgggcagacaactcataggctaatcgtcaaatgactaattctccatgttaatgaatcagaataataaaaatgaataatatgtagatttcatggatccaaaattatgcaccatgcattttacatgcgtttactttctcactgaatcaacacaattttgcaaattatacatcctattttacataagtgaaaattgagggttggagaaaagaggcagcatttgatcccaggtcacctcaactctaaagttagactatgctctctctttgacatatctctgtataattatatggtatttttatataataatacagaaatacatttgaaagtattaatagctaaaatttattgaccacatactatgcgccaggcatttttctatgctttatgtttaataatacatcatttaatcatcacagtaactctatcagacaaatagattagtatttccatatataaatgagaaagatgaaacagggaatgattaagtaacttgtctaggaccacagcaagtagtcagtggaggagcagagaagtgtacccagaaccaacccacctcaagttcttaagcatcatgggccagcccttgagtatggtgtttttgccatgactcaatctctgacctcaagaatcttagaatctagtaatgggaacacatgcaaaaatgcagataacatatataaactatagtataactcatatactaatattacccatataaacaactaaattagaagatggggtaacaacttccactgcagaggtacaaacagctatgctaaggaatgaattgcctaatgtttgcagacacgcaattcaacgaaaagacttgggttagtctggcaaagcagagaggtacataatggataaagtgtcaaaccctttcttccccttacttgttgtctctctggagattaggtgagaacctgatccactcactgcctatcaggagacttctgtctttgaaactaatcaggaagaatttactggctgttaaactctatggcaagaactcttgtgaaggaatgaaacaaaaggaagggaaactaagatgaaagtgagggatttgggacacaaaataacgcagagtcacttcaagcatctatgtattgttccctatagcttaaaaatgattatttcttgctcaaaatgtgcttataatacagaaagcaaaatctgcatttaaaattcttaagtaaaggtatattgttattatgtaaaccaaaactgactttaagtgaaataatttaggttgactatagaggaaaatttcctgactgtatgattgctaaattctaaaacttttattcagggaatatccagaatttcttctgaacgtcttcaaaaatagctctatacctttgccagccttcaggaaccaagcttacctgcatgcaggcaagaagggccagtggtatgtgaatccctagcaatttggttgtatatacagattgtacatacacatggcctcacaattagctccaaagaaccagtccacgaaacatttaacctccggttatactagttatttgtagtggatgccaaattatggcttgctacctcagtccattaaatgctcaacaaagaggaataaaaatgtgcatttttaatgctcttttcatattagcatatagtccctaccattctcctccactacacctcctcggaaattctgccccaaggtcacccttcaacatttcatcaagttctgttagacaaactgtatcactccacatagcccagctgagtggtaagggccatttactggccaagggacctttggctagtataaagtatgtaaaaatcagttttctcagcagcaaaacaagaattataatacttccctcacaagagcttttgtcaggatttttaaaaatgatgatttagtctataaaggactgtgctcagacacagtaagtgctcaataaatgggagctattcaagtcaattcctagaggggcacataagtacttctgtggcctataaagcaaaaatgaatctcttccacagcattgtttctattcgcccctaagtaaatgccaaagcctgtactctaactaggaaggttttgaaaacatgattcaaagagccatagggggtcctcgcaggcctctcaagaagcctgggaacagagcacagccgaccgcccaatctctccaactacaacttgatgtttgcttggtggtttggcatttgtttttccgttttacacattagactttcgctaatgatttttgtgaacaatggttttttggcaaaaaaaaaaaaaagctttgaaaacaattgcttaatccacatgtcagggaaacaattcagatataatagagcaccctaagtttcatctggaaatattaaaattactctgatttttatcatctcaccacttaaccacttacaaatgaagcctaatttgaagatcttcaacatttaccagtattctgttatatttacaaagcaattaaacagtggctaagatatacaacagtgcagaacaattctaatacatattaagaccctgttaatccatctgttacaaagaacaatgcaatataatggtcctccttcccctactaaaaatgcagcctcgtgtatgtgtgggagtaggaagtatatgagatatctctgtaccatcctctcaatattgctgtgaacctaaagctgctctaaataaataaagtctttaaaaagtcaaaaacaaaaatcacaaccttaaattcacactccacaacttgaccaacctacctcttcagcccatgctgcaggtactttcactagatcccctccaccctgaataaactactttctgtttattccccaaatccatatacaaggttacagccagtaggcctttgctcctgttcctaaggatccctggaatattcttcagctacttgccccatctcttttaaaatcatatccattgttcaaggtctagactaaattattcctctccagaaagtagtttctgatacccctgaacagatgtgctttctctctctctgtccatagcatttcatgctttattgtgacactattgttctaatatattagtggcctgaatgaagcagaacagtttgatgattgccttggcagtcaaagaattttctaattgtcctggtatttgcctgcatgtggtctttagcactgatatgttcacatcaaatatcacagaagactacaaatttaaaagcatgcttacaatatcagtggaaatgaattaacaatccaaatatgctattggttttactgtgtatttattaacaattactttgtagtcaagacacaataatttctttttaaggatgtttacttttctagttagtaaatgtacgggatggttttcactaaaacataagtcagccagctgtttgtttgggttcttaaactgaatggtaaaaatacaagcagctttttctcaaagtactccactttaaacaagggaatctgttccatatttaaatgatttaattttctttttctaaaaaaaaatagtttaaatttttcatataataagaacatctcctcttcagaactttcatttcaaatggcatatggttctccctcacccatctgatgccccagggatgccaaggcacttaggagacccaagagagtgtgtaatccgacatgacagctgaaagagggaaggctgacagaggcatcagaacaggtaccagggagggagaagcatcattctggaatctgagggtttacccttttactttcttccaagttcaccaaaatgctgcaatttacatctccttgagaagacagcatcactgacccaaaggtttcactcagaaatgggctggacccaccaagacaagcagctttgtgtaccttaaacttcactaaagcagacagactggtcagcgtttctgcacttcagtctcctaagttctccataacccagtgtaagctccagctggctttgtagtcagcttccctttcctctatatggtgcatttatgagttcggctgtgggccctgttaatttccctccacagcctttcttctcttcctaacacatgcatacttgagcccgctctggagtgctgactaaggaggaacaataggaggctttgagcagggctcaagccccagacccagtcaatatttacttcagtttggaggcactgttttaaagctccttccaagcacaactcaacagggggagtccccagaggtttctagattttattttaactagagggaagaggggtatggagataaatagattactgtccaaaccactttctcagagaaaataagagaggctgttcaacaaaacaggttagattttcaatactaattagcaatttataacaagaaaaaccaatcgtcttccaacactgattattgcagtcttaaaactccatattcaggctgcagtgcaaatctacttaatgtgacccatgtatatcttgtgagcagagtcctgatcctatcaaccactcaagagcttgccaatgtttgcctactctgcccagaatggtaatgcaagagctctaggtgaagttaacccaaactccacgactgaattccaaaccaggtcttatgtatactattaatatgtgattacaaaatgaagttgtgattaccaaaccccatgaattaagagtatgctatgataaacactagtaagtatgcctgttatctttgcagtagattggaaaggttaatctatggctatgaagggagtgactaggaaaaaaaagtcacaaatactctcttcccaccagtaaaagaggcttactatgggacagcatgtgagaggtaagatggatagtttgttctaataccatattagagccaataaagcttccctgtgggtttacattgccttctgttgacataaatatagacagaccttctatattaaatatgaaactacttaaccataaggatttttgtatttgccagtgggtttaaactttttttttaaaggtcaattgccatagaactaacccaaagtgacagttgggaaattttactaaaatgattaaggctatataaaattactaaagatttgttagatacctaaggaagaaattcatagttgtctgccataaccaactataatactcattattccattcaaatcattaagtagactttgttccttttgcttaaagactcaactgtatattccattcacattttgcaacatttccataagaacagagccaaatgatctaaaaactttaaaaagagaaattgaagagaatttacaactgtccaaagttaaaattctagtttatgacaaccttagtactaaagagcatcttctgtattttaaacatgtaaaatacattgacataactcagcctttcacaaagagaaatagagataattcaacccattcctccctccaaaaaaaataatgaggtaaaaggtgatgcaccaggattagcctgttcaactgtctaaattcatcacatgcactggaatctgttcagctctagcctttagtacattatttaccatattaataaaagctgaataattaagctgcaactcaatccaatcatttcaataccttaaggaattactggatagctatacacatgcaatctgatcaatcaacatgcgctcatggaaaaaaaaaaatgctgagtaagcctggctaagatgcagtctttggctgatattctttaactgatgtacaagaatataaggaattagtattttaataacacaaaatatcaataagtaagttatcaaaatttaaacttcttgactacccttttgccaagaaagtaagcctggagcaagggagtgactgtaactaatatcattcatcagacatggaatccaagtaacataaaattaccaagcttcaaacttgaaataaactcatagcaagctcattcccttgacaaattttaacttccaatttagcaggaaaaaagaaacctgcttttgtacaaaatgatataagagcaacaaaggtaaatctagctttcctatgagcacagcgattgtaaatattaaaatgctgtacttttaagagaaatctgttatgcagagttcacagtgttctttcaaataattttggtatggcttatgttagacccagtatttttattactagtggccaagttctgcccaccaacatcactaaatttctgggtacagcgcataaggatcattgataatttcccttatgaattactttttcctggcataaatgaggtttgtaccttcaggagtaaaacaacattacaaaatgattatgtaagtatatgatggaaattttttaacaagtaacaggcatatttgctatccatctaaataactataaacataggaagtaaaattggctttgaataaccacctgacaatgctataggaaagcagccctttggcagtaatctattactcaggtttcaatgcattaaaatatgtgttccttgacaaatcctgtttcctttctcagctacatgttgttatgatctatttatacctctaacatcaatgtgtgtataatatgtactaagtttaagatagtcaatagcaagagttctcaagcagagcgtcaagaggttaaaccctgctcttctggcagcagaattcagaaaaatccaaggatcccagggacagcccagctgcccgtaaggagcaggcccagacaggaattgatttgtttcaacaagctcctcattggaaatacaagcattctccaagaggatgtcggtattcattaatttctcctttgagatggagatatctcattataactatgaagtccaaagtagaatatcagggttttagaagtcaaagaagaaacaatatagcagagacaaactgagaggagaagggaggacattaaaaataaacctggccaattttacaaaggagattcaaaatccctttcccgggaagaaggtcctggaagacttgcctctcaagagtcagtctttacacattattactcttttagaaatcacaagataaaacctaaaatgtaaattcctttaaataaaacccaatgtaaatgtacaaatcatctctcaggaacaacatatattacaaaatgatacaatttggtctaccttttaaaaattcaactcttctgtgatgcttttaaaataagttttatttgtaagaatgtattttctatgcaacttaccagaatatatataaagtgagattcacaagaatatatataaagtgaggttcaaagtgaggtaactccccttaaatctctatttcccccccaatttattgaagtatgattgactttattctttttacaagttttatatcagtttttaaagtcctgccacatatacacattcctttaaattttcacaagtctgagggagatatttttattatacccatttatttattagggtgaagaaactgaggcttagattcaccactataaatggcatacttacaactcaaatagagctgaaatttaattagctctgaaataaaaccaaaaaattttaacagacaagtgacaaatctaatctgatataggttttttaatatcttactttctgagtccttgcctatccaacacccaaacaaatttaaagtttgatctgtaatagttgctactgtaaaaattcaaaacaaaaaagtacataaacacaatgtttttactatacgcagttaaatctgtataggaacatatattagtatatggaagaacttggttacaacctattaatatgatgacaagtcactgttaataactttgagttaaataaaaacaatttaatgtgcttattttctttttttaaaaatggaggtgaaaaacagtattaagaactactgagcatcttctacttcatctaaaacacaaatcttaggtatatcaactctattttcaacaaatccattcctattcctaaatttaacaatctttgaagcatatagcatagttcttttttaggagccacttaagttcacacagagtcacagaaggttctagcatttcaggatctatgagaatcataaaactggaaacgctaagtgcttgtcacccccaaattcactgtttgagaaccctcgtttacaccacagtgaacataaacataaacttacaaagaaaacagtactgtcttgatttactattcttaataatattcatagttattatgaaatagtacccaatgttctaattaaagccattgaggatttaaaaagaaaaatatttgcttctgttttaaaattaactatcaaaaattgttggtaaaaatttctttttaaaataaaattatacttaagtggtcactgtcctgttcatctgtttcctttcataaaaatacacctgacttaaagtacaaaccgttttatctcttttaaaaataatcattccatagaggtacatttcaattaagtcagtctacttaactgatgctttcaaagacttgaaagttcatttagattagtaatattgtatttatatacacagagtgaagatcagtaaaaacaaaaaacaaaaaacgcagagtaatcttctgaatttaactagttccattccttacttgttaatacaaagatttgctttgaaaaagcaaataatacatacgctgtgaggaaagcagaagcatatttgcagatcttatattacctagactctacaggagcaaaagtttctcactaagactactagaatcatagaactttacagaaagaacgcattttgtcccaagtcttttataactccattgaaattacaggctcctgaaagccacccacaagaaacccagacattgaaagtagaaaaactgttagtcatcttttatgttaatgtaaaaagaacatttggggttaatttaaccatacggatttaagttggaaagtgttaaaaatctgtttctgcggtgtaattctggcattgccacataaaatacatcttgggagggtttgcttaatatctttagacatttatgacaggatcctccttaaactttttggaccaaggtagtatttttattccagtggaatttgtctacagagaccaaatcttataatgaaatccctgtcccattacctttgttagtggtgtattttcaatgaagcataaacttcaatgtaaaaatctgttttatttgtctgagttttgaaggaaagtggttagaaaggaacattaggcattctgggcttcttaaatggcaaataattttccttcacataaatacggagccattttagaaactgcagaactctatgaaaagttcagcgcaaatacaaccaagagtccttgaagaagagccagaagtcatctctctcccacttaattttatctagaaccttgctgtgcaaaccacggttcatgggccagcagcatcaatgtcatctgggagcttgttagaaatgcagactgtcagggccctatgtagcccagacccactaaattaaaatctgcatttcaacgaaatctccaggtctgtgttcaccttacagtgtgagaaacagtgacctagaaattactaaccgaatgcttcatgatgacagggatgctgtatatatgctgtttactgcagtatctccagtactgagaacagtacctggcccacagtggacacctgacataaatatctgtcaaataaatctacatgtgcacatttatggtactattttatactctgtaatataattatatgtataaaattattatatctgcacaatggtcttaagttccttacaggtgcaaatgttatcttatccctgaatccactgtatgtctcccagtgttctgcaaatatcactcaatagtttatcaatgataacttttagatattcaatataggaatatagaatttcttcagtgtgaaaactttggaaaaataagttcaagtcaacatgtaattgctgaattcatctatttggctttggttttagatacagctaagagtgctcaccctaggaatgaaaatagtaatggaaaacattatataggaccaagttctgattctatgtggtaccagagaacagggatggcgtggatgactgaaatccaaaattgattccaaaacttcatgttattcaatagctttaaggtcttcccttaccaaatcttctatccaagctgctaaaagtttgagttttttgggttttcctttttttttttttttttttagtttccttttctttctcaaatcttccataggtctacaggcccagagacaataaaatggctaaaagccatcaaaagagaaaaatagcaatagagagatttacataataaatgaagtgattagctctcaaataaccagatgtcaatgaaaaatctagagctaagtaaaaaaaaaataatttgcaaaagacgtaatgataatagtcagatatgttaatatatgtattgataacaagaccatgccaaaataatattcaaaataacgagatattcagactcacagatattgctggttctctcagttcatattacaaaggaagaacgctaaaatagggagacccttcctaacaaagaactgcattttttcattttaattaactaaattaatagtcctttctacattttttttccttcagagaacagaggatgaaggtaaaccaataggtatgtctgaccttaggtgtacatattcttatggaatatcgtgtatacatatacccaccccctcaacacacaccacctctgtcatgttgtcttcccaagagtatagttgactatggtgatgtcaaagtgtgtaattagttttcattgttcccttgatagctatagttccatacaagaccctttgcttttgatgctgtaaatgctatggaaaaaatacactaataacaggcatttaattatggttctagcaaccacagtgggaacactgccagaaaaagactggaacctctgagatggcaaaaacatatatatatatatatatatatatatatatatatatatatatatatatatatatttggcaagtgggggaggttctgttcttcaattacagtaattttcaaaatattaatgacaagcatatggtgggaaaattttaaaatgtttccttgaatctttgttgacaataaagtatgtatacaatgctacacccatactgaaaccaagaagaacactatcatgtctgtaactaaaatattaataagaataaaggaattgcttattaatcagggaaatactctttagaatagctttatattttgatactataggtaaagagtacaaagatttcatttcaaattttgttttttgcctggcttttcacagactttaaaaaaattatcacttgtgatacaaaatacctgggtgctacattctctgatgtttaatttgttttatacagtatttaaaataaagtatcccaagttgctgcaatggcagacaccagatctatcactgaggtcccttctctccttattaattagtaattgggagacacattttggcagctttcgtttccccattattttctctagtttgacacaaaaccctgtcagaagcaccactatttgaactgtacccctcttagtgctgggtcactaaattttaataaacggagctcccgccagaaaactactgaaataggcgtaaaagtttattgaagcagtaacagtaaacaaatatatgaagaaagcactgaatgccacagtatctaaaacattaatggtctgtctgaacccaggggttactggcgagattgcagagcagaggctaaaagaaaaggcctttaacaaaaccactgctttcatctgtctgttaaaaaaaaaaaaaagaagaagaagaagaagaaaaaaaaagtattagctaaataaagcaggcaaacactttgctgcagcagaaccatacatctgagcttcccttagcctccattatcccaacatgttgaataaaattattgggaggcaaagatttatagcgactatatggacagagaagccatccggaagccacaaaagctctgtctgagccaaagaaacattttcataaatggtaaggtgagaaacttaaaatgaaaactaaaaagactgatactttggaggtctgcaaatagctacagaatcagtttcaagatctccatctcaaagtgtcagtcacttcaaaaacgcatcctgctacgatggtggctcaggacacttgtgtgccagggcagtggccatgctgtgcaagtcagaggtcaccgcttccacattccgacatctgtctgtattttcttgccctgaaacaatagaaggggaactaggctcatttgctcccactttgtttaacctaattgttagacacaaaagataatttcccatacttagaattattttttccttttccccccattctcatttgtctccataaaattaaaaactattaaaaatgtaagcacgtgaagttgtctatacattattgagttcagtaaatgtaacaaagttgtatatcccactgacatctacaaaatataaaacatcaagtatcatgtctgtcatcatcacaacctagataacaatttgcactataattatccaacctaactatgccataacctcatttaattcaaaccacaacactgcctgtttcatataaaaatactttcatttacttttataatttccagggaaagaggcaagagctaattcttaattatagtttttacatatataaataattaataaattttaaaatggaaactctgacagcttggaaacagcaagaaaaaaaacaaaaggtatttgttagttcatttaaaaacaaaaggtcactttgaacattcaagttattttagtcttctcactagccaaagaaaaacagatgctagatatcagaggaaagttttctgcgcaaaaatggtcaactcgtacctgaactttaaccgcgatacatgtatctgttattaaaacatgcatttattgcctttacactacatctacaaccacccaaaatcctacctctaatgaactgaagcagtttttcataagtgacataagtaatatttcactgtgcccagcttaatcaggctaagtcaggttacttttgaaattaatcttacggaagctctgcttttactgcagtacatgagaataatgttcccagccatcatcaaacacatgcagtagtaagcagtatagtataaatttttagtaaagtttattaggtcacttggttttccaaatgtatccagaaatacaaaacatgacagaaaatatagcagtcagttgatatactctcataatttttagtaacaaatatgaatttacttgtaaaataatctatgagaacccacaagaaagatttgttctaatgtgataggaagagcctatatttcagagacaaaaaggctctgacttaatataacgcatcttaaccccaactgcttcatatttagaggtacctatactcttatcagtaccttttgcgggagaaagattccgggtagacttgagtaattaaaaaaaaaaaaaaaaggcaaccaacaaataaaaagaactacttagcatagtcagaaaaatgaaatcaggatttgagggtggaggtgacaataggggctattaatatatcactttgaagttagccataaagtataagcttcgagaaaaaaatatgtatggaaacatggtacagcccaacatttaacattaatatataatatgcctgggtttaagcatattattactaagttaaaacatccttttctgtcaactaaatataagaagatagcattttagtaagttcgcaaataagatagcgctttaaatgtagagagccctgccaaaatgatcataaagtggtttagtccttttctatcgtccatattcatttccgaaccaatttcacgaaagaaataaaatcggtcttaaaacaagatggctgcttctaggggggaaaaaaaacacgctgatttaactgaaagccaaaaaacaagcttttctaaatcaggaaataagcacttaatcatattttttctaatctctaagtaggtattcatgtgtttccaacatggtaatccatatattatactgcgtggttattttaaatcattaatagcaaagcgatttttaaaacaggtctaatcaatgtgtactaacaacatgattgtccaaggcatatacatatttgctaacatatatgactgtccagagcatatgccaaaactcccacttttagttcacaccagaatcgtgatcatcagtcatgaaaatcaggtcacttgataagctataatagaaagaatatttatatcttatatctcctaagaatccaatcataaaacttgcagcaatatcctattacaatcaaatcaactgtacttgactttttaaaagtaaaaatcataggaactttactgttagacgatctctccttgagctacactttgctgaccctccctaaagcaactggaagatcaattctgatatgcatataaaaattaagagcattttatccatcttgaaataattttaaaatagatttttaaaaatcattcaaacgtatttttattcctcacttgagtggaaaataagacctgacagtaacattttcttcaacctgtcaactgtcaattgtatgaaggatgtttctaaagatgacaaaggtttatttttccttattgaaaatgatagaattctacctgaatgaaagctgagctaaccatcactgtggtacactactgtctctcagcaactagctagcctaaataagagttttcaatattttaaaataatgttttcattgaactatatggtttactgtttgaaaattatattcagaagcctcaaaaacaagaatttgcatccactcaaatttttcaattagaaaatagcacacggatttcagtttacaataaatcctttagagagtacaataaaaagtactatcaagaatatgaagatattaggaatgattttactcaagatcatgcaaaatagttgtagtcagaaaaaacttgattaatttttaattttaagctagatggtcctgtgtcattgtgctcctttatgactgactaaattttgaaaacataaatgcagacaaatttaagaggaaataaatctcctagtagtgagtaatatcctattcagaagcactggaagttcacattaatcacaagaaacttttctacaaaacagctcaggacataggttgaaaagcagactaaaatataaatttgataatataaatcaggcccttaaaagagacagtaatttattgatgtttggctgtctaagaccaccatcgtaagacaaattattaaaagtgaatattaatacctcatttcttatactcctctttgaggattttatacctgaaaatgaaggtgttatccatcacaaatgatcaaagggcaatttttttcctcagttcagaaagcggatctgactgagttgtcctgggtaagaggcaaggaccttcctcactgtgcttagggaaattgaggcttcctttgcaacatggatattctaatccggaatgctattttaacagtttgtatactgcttctgaaaagaaaattgataatatagaatcgtcaacacagagtcgttcattatttcaaacaaaatatcacagctttttaagtctttattgctaccgaagttattcaacacatgcacaaaaatgaggaaggttgagtggtatcttataaaaaatttttaaatttatattgaaaacacaaaccaataagccactagaccaaatgctacccaacatgtaaaattctattcttaacatattctcatattttgttcatttttattttaatgctttctctctctcaaaggtaaattttctggcatatacttatcccaagctagcaaaggccagaactcctgaaggactaattgtattcattcattttcttggcccagcgtgaagctggtagcttgcttggttcatagcaacaggggagaaaaggaggcgcccatctttatgtccttatccaacaggaaaccaggccagtggacagaatgcagtgaaatgcctgttcagaaggtattctgcaagattaaatggcaagaaattcacaaggttaatttgcacccaagtaactaagtgttccctccaaacctgatcctcagccttcaaaggtggaagcttctgaagctactgtcagccacaacacacatgacaacaagatattagttcagtgagctgatggtttagttattaccactaaaatcacctaacagagagtaataaactactgaagactctgatacttttaatcactagtagtttactgaccttggtcttaccctgaaaatgccaaattagactgtatagccaaatctgcctcaaatagctctaatgttcctatcatctaaaaatcagacagttgagtatttctgatagtttattgtgaatatataaaataatgaatcaaataggtagaacatatcttagtagctaactctgcttttcaaaattctatggaaaactcaccaaaaaacaggaatcatacttctcttttacaaatttctagattaaaaaggggggagggtcaattcacgtctcttataaacatataagcataaaaacatgggttataaacctcaatcatactgccttatttttagcctggtacttgcataaattctgatctaaatttcagagtaacaaaattactaccaatacatctaataatgtgatacgttacactgaggcttaaagttaatgccttttacttgaaaaacatttatgtttctaacatacaaaatattacttaaaatatttaaaatttcaaaagtaaggacaatctaagttttgtgatgaaactcattcaagaccaagataaactttcaatctttactcacaacaaattcttagatttaaaccatgctgatttcatttacttgtcagtgaaaaggtcacagtgccggcatactggtatacatatgtcaaaatgatgatggctcagattttttttaaatggagcaactaaattttgaaagaagaaaaatactcaagggaatatgattaggaaaaaaaaaatgttactacttctctcttcttagccacatacatttgacctgtactgccagaggacttgggagtgttgacctagaattcacattactttcacaactccaagattacgtgttaacaaaactaaaaggtgtcaattacctgctactctaatatgaaatgtttaatatacaagtccctacaagaattgaaaaagtccaaagaaaacatgattaggttaaagtttagtaaatccttcatgacttacacagatattttcctcttaagagtataaccttttaaattgatgatactcaaaccttaacagaagcaaagcaccaggttgaggacgactggtattcctaaaagtgtgttggtcatatttgctgctgtattatttgactattgcatcaataatgccaaccagtaggagatatgtttaattaccctaatatcatttcagcaaatagtcaaaataatccaagaagaacttagaatacgcacatgatgtttaaaagtatattcttattagaagcaccaaactgcttatggcatacttcagatgaagaggcatgttcttagtattatgactctctttataagcatagctactaaaggagaatgtaaataaacttttattactggaagtctttttaactttatttaaaagctttttacattcttaaagaaattaaggacaaatagttatattcttcttgatgtggattttcattactcaaagttacttggtgacattccagtttagaattcagaataatattaaaaggatgatttgattatttacacttttaggtaaaacttatacaagttttcaaattttggaaatatagaagatctatttaggcaaatgttatcatatatttctattcaaactgatagttctgagtggctatttcacaaatttgtgccaattcaacacataaaaaaatcagtttggtcccctatccaataaatactaccaactaaaagttatcagcatttgaaaactcagtatccacttctcagaagtgaatacctgggtacatagattgtaacagtaaaactattctgacagcaaataaatttaatattttttcccgtgaaactacatctatagatgctcatttatcaatggagaggcagtaatgaaactccatgtagaagataaactcctaccagatacacaagtgacacaagttacacagtaagatactgtacttaatccctgtgatcaagatacatttaattctgattttacctaaacataatttcaaattgaatctgttagtataagctaaagtagatttacttcgtttagacacagtgtacattatcatcagtttaacgtgcccactgaacatattatattctgagggaaaaataaaaaaaattatttaagttgcaattaaagtcctctattcttttttcaaaagattgaagtcttactagtttagcaaaattttaacagataggttctatataaagacacaaagcatggctagcttactttatgaaataacatacaggaaaaggaattgcacaacagtgaatttataaaatttactaaacccgtggaaattttctgaaatattttcttactattgtttgtggaaaactgttagtttttatttttaaaatacttatttggcatgtggcctcttatatccaagttgacttttcttaatgcatcaaaagagcaacatcttattcaacacttcagagataaaactgcctacttttaaaatattgtttttaaagtaagtttttaactgtgataacataccaagataaatgtgtccataaattcctaagaataataagtgttagggctgtatctcttggggttaagaggggtacatcattctttcttttggccattatcaaactgataatgatcaaatagaaaggtaattctacaaacctgaagttagaataccgatttagaaatactcttggtattttaaaattctgcagattaactttgtctgggcaggttcaaagcctccatggcatcctgagcagaagagttttctgcaggcagggcagatctattaaaaaacatgacctgtgacaaaaatcaatgtgctaatctcaaaccaaacaacagtatcaaaagcacaaaacagagataacctaagataaaatgtcctcaaactaactcagactagcttgacaggttaagaaggggggttaaagtaggggtgttgctggttctttccgttttaacccaggaagactggaacacccaagtatccaaataaatgaatgccatgagaaaaagatcacaatgtggagcttggtgtgggaaagaaaagacaaccgagagcaagatatcccaaattcaaagaaactatttcagtgttgctttatttaataaggtgctaaagttcagagatacaaatttctgcttcgtatatgctgcctaataaagcacaaacggggaaaaaaaactaaccaacataatgagactggcttttaacaccatcacaactggaaagcttgctctatttgtcttgtcagctttaataaaaggcatctctcctctggcaggatggcttctttttctcttttcctaatagtggtaagtggcatgtcaaagaagaaatcgcttcccattccaccacccacctccaggagactcttgttttttgaaccaaactttcaggaatatctccactcctgttcagcggttcatttaggacttgggcggctacctgagtaagactatcttggactagcgggatagggggaactccctcctggttctgtaaccggcggactgcttgtggggaaatcttcccatcttcatctgcgctgacattattcaagcagggaatccctctcttgcctgcatgctgaggggaggctggaggcaggcggagagggcccgcaggagatagaaaaaactggaggcgcccaccgataccctctctcctggagcccggggcgcgcaccaactcttaggctaacccctcggcctcccgcctctctcttcccaacttccactccagcccagtgaaaaacctgtgactttagatgcaatcggtactattaataaatagcacctaggagggcaccgagaccggcacacagctggaagctagcctctgtcccagagaaagcagtgcggtatgggcctagcggggccgacttctgtgcacaggccgggaagcaataaaggttcggaactgctccagacccggaggaccccgccgggcactctggataacctccccactccacttccagggtccgaaaacacgggacgtctgcgactggccggtgtccagcacgcgcactaggaccgcccccggcgcccacctctagtctcccgcatacccggcgggcttcgggacgcctacaaatcggttccaggtaatcgcgcgcgttcctccggcagcacatcgccaggccgcgggcgaagggctcccacctcctggctcggccaactctggcagcttgttctgcacacatgacgtaacccggcattagatcaaactttctggcaccttgaacccactggggtgggtggagggatggagaagatgggagaatcctctccactgccaggcgcgccgggcccagactgactcaggggccgaatgatttcctcgcagttgaagaggaaaataaaaacctaaagcttccgcttcccagcccccctcacttcccccagcccgtgcgctctctctgcgcgcaccgggaaaagagaagggaaaattaaaattaaaaaaaaaaaaaaaaaaaaaaaaactttgggggatgtttggcgggttctctccgcagtccctgcggacccacgctccaggaaggagctcccggctgcgcacactgggggctccccgcgccgggaaccggatgccagccagatgccggggctgggaagcagagaagtccctactccccggctcccgcccttttccgagtctcccggcgccccgcagaagcagttggtctaggcagccccggggactcccaggggtacctggcctttccgcggcggcttaacaaagaggggcgcgacgcgagcgcttcccgccgacgcctcaagccatcagcgcccgggcgacgcaggctccgagggtgcgcgccgccagcggttggtgcgcgccgatccccgccgccgctccttccgcagggccccgaggcccgggtagccctggctctccgcctgttatcggcttacctggggttgctgctgttccagtagacagcgtagcggtcggcgacggccttggagcccgggtcctggctgaacacacacatccagagcaccagaaacaccagcgtcaacatctccacgtgcaacatcacgcctggccagcggcggagcccccgacgcgccactccggggagagagcggggatccggagggagggaggcaggcaaagggacagagagagagcgggcgccaaataaatatgaataaataaaaatgaaagtgggcgagaaaggaaagaggcgcccaccaagctggggaggggtaggagagcgagaagaaaagaaggcggtgggatggggggtgataaagacaaactcgcacccccactggagggttcaggaggaaaaaggaatcacaagatggagagaagc

SEQ ID NO: 818 - DNA, 374612 bp, Homo sapiens
tcccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 819 - DNA, 292823 bp, Homo sapiens
tcccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 820 - DNA, 582065 bp, Homo sapiens
ggggagaagtgaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcaggtctccgtctctttctcgcttcccctcttttcctcttgattgtctgggacgagctccctctgggctgccagagtgccggggctaggtgccgcaaagtcccgcggcgagtgccggggcgcggagccgagcgccccgggccggtcccagggcaaaggcaggggcgcgggcggacctggcgacgcggcctcccgggagctccgagtgcgctcgcttgcggggctgcaggtgttgcgggaggaccgcgtggcgcggaactttctgccgccgcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttctactcgacccgacaccaggcgctccctgggtcttgggtgtcttcctcgacggttgccttcgtatagtgccccctttgcctcgctttttcagagtcctcttgcctctcattctcgccgtgtgtgtctctgcctctgtttctctttctgagccttggtcccctcagtccacactctccggccatgtatctgtttttttctcttattctgtttccctctttctttcttgggatatctgtgtccctgttaatctgtctttccttttgtctctccgttttgcaacatttgttctctttctgtgtctgcttctcgcagcttatctctgtctccctctgtcatctctctgccccgtcttcccgaacaccagccccgcgatcccgaagcgccttggttaggggagcaagccctggcgcatctaatgggtatctccaggtgcagagattttcctgcggggtcagtggggacgcggaggagacagcctgcccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagctttcttcaggcaaaggtgttgctagcagaggagaggagctttggggactgaggtatgcctgccttaaactaccatgcattcattgcttaggaaagcggtttccttggagagatcgtggtcagccttccctgaaacaacataacaacatagaggttttattcgcaaggctaaaggcacttggctgccaaagcccccttgaaatttctggtatccttgaatattttcagctttatgtgaaagctgcctttcctcagagtctcagtccgtctctctctctttctctctctctctttttctgtgtctctctctctcgctgtctccctgtctctctctctctgtctcgtttgcgttcatgccctctagtgttaaagaaacctgctggttcgagaatattgaaaagtaaggtcaacctattggttatttacttttggacctctcaccttccgggataattctccttgtattacacgcatcctttccttttcctcaaagaatgacttttgcattacattactaatctttctttccccccgcacccccctcccgcaatctctgttttttttttttttttctttccccacgtctcctgcagaataagaaccttcatattgaaaccctgttcgtttgatttgggaattggataggtctggagaatttgcgtagcctaaggcagactttgaacattaaaaagatgcatttctctgcactgtttgccataaaccaggatttcacatctctcctttagcccctatccaccttcaattccatggagaattttcctggctgcttctgcttgtttaaataaatgcttttatttcaccatttctgtgatgcttatcccattccagggcttaaggtacttgcttaagtaggggcactgtgtctcggatccgctttggagaggaagaatagaaagcttttctaaaggaattatagggtactgctggtatagattaattccagttcggaaagtcctgagtgggaatgtgagaatggaggctgtctcagatatgtagtccctaggacagtgtggggaaactagtaagtgcttaataaaacttgttggttgattgattagcatgcagcggatcataggcttccaagttaccaggtatgctaaggagcctgcagctaaattccacctccccgctccttttttgggaggtttcatttagattttttatgaatggtaattgagaactagtagaagggatattgaaacaggggtcttctgcttctttgtagttcatgttattgcttgaatttgcccctttttgcaagtctacaacttggctggtgttctttaacacagtcattgcagaattgaagaaatgagtttagaggggccctgaaatgtggcatctctcaatctccttacctgaaagtaagttgggacatggcatcatttttgggtgaatactttcatgtggtttctaacaagtgaaaagttctctcttttaatataaagaacagatatatcagcttaaaatacttgggggctatatattgatctgtaagctggatcacttaccctaaataatttatggattcccctactgcttcatatatatatatatatatgagatgtgcgatactgcatgaatgtgagaatttcctaaagtacctggaaacataatgcctcctaattcaaagtaataatagaaatccatgggcagcaatactactttcttgatgatatgctagtcacctcttaaaatagttgctaatttatcatgagtatggtgcaggagcatgttcaaagcaatttttctttaaaaatattatttataaatcacttgatactgtacccaatttttatatttaaaaatagcaaagacataatgaaggtggaaaatctgatattgtttgagagaccttctatttgttttacaggtttaacttatgcatctaactttttaacttactgggcagtcatttcagtttaaacagttatgtcagagtgaactatgttgttatcatgccaagttgatttctagaaatagtagttgtaacaggagcattttcatgtaatagagcttgtacagcttataaagacttcgggattttaggaaaggggtgagataagaagtaacagtaacaaatgggtatttttattctttatgaatgggcagatgaagagaatcctggtgtttctgaataataacagtcgagaaaatgcttgagaataaagtaggaatagaattaagccttactgtctaaaataaattataatgctacatatctctgttaggtgttcattgtccttttaaaaatggacacttcatatagttatgacctttaactaatttgccttattagacatgatattttaaagagaaacctcttgcaacaaacaacacattcttgacagcgactcttagtacatcaccttcttgtatttgtgtccctgtcagaaggaacatgtagacatcttaaatctaatgggatctaacaggatcactgctttgaagtctgaatgaccatatgcctaattatcaaaggatttaaactgggctttggttctaaatccttccctctgctcttgtcatcaaaataaacacatgtgaaacatcaaatcaagtcctacatatatatactcatatttattctgacaacctatttaatgacatttctaacagcaacccccccacactacacacacacacacacacacacacacacacacatacacacacagtggctaagcatatgtttgaaaacgtaaatcacatttaaagatctggcactgtctgctttgataaaccatttattattttatcagattagacttctgtttacaatttctatcaaggcacattgttgaaggacttctgccattcaaatatatgcatacctgtgtttgaaaagtctggtttttcattgtgaaatttagcttttcaaggaaatttatgaaaatgaatacatttaattcagtaatagtcatccgtttggggcattataaacaattatatctagtttttgggaggagcagtgtaaaccaaacagactttaatcacttgatatttgtttcttcttgatttcatatttagacctgtgtctgtgttttcagtgtagtgtatctattataatacatttaattggtgttagcttgattaccaagaaatgattacaggtggctaaagacatctgtgtgattctgattactgtgtgctctcatgtccttaaattcatttatagctatgagtttttcaagctgtttttagtatgtctttagacttatacatttaaatgaaattcttaatttttaaaagttatcactgcagagattgatgggatctaaaatttaaattgttaagttaaagttgggagacatgcttttcctttaagggctcaacttcattcaatgtccacgtaattagagtcctcatgaactgtcaggctctctcttaatgtgtacactaccataattacctacccttcagaaatgaactcaaacacaattcaaaatatcagttattaaaaattgttccaggttaatggttaatcctctcaagatagtttgagagggatgtagggagaagaatgactattattaccatagatatgaacatatttgttatcatcttgtagactatgtgagaaaattaaatacaatgtccataataaatacttagatttctttcatattttttaaagatatgctcattgttaagatagatgggggctgtgcaagatatatcatgttaaggttttaacatgaagaggaattaattgggactctgtttcatatattccactacattgaattgtcacttaaatcttatttaagctcttatacaacattttaggaagagtgtgattaatctgcttgttgacacattggtgaacgtaatgcatgtggtgagtagccactgtaaacagaaagaagaatttaaaagcatagcacaatcaaaaatcatccaaataacatcttgaagatagtagtaaatgtcaacttagtctcttgtcttatattaattgccttgatattacaagcaaagcacctcttttttgttaataaagtggattttgacatatgaggaggattatgtagcttagaagcataataactgacttaatttcctcttgagattattattatataattagtttcagatagagaaggtgagatttatatgactatcaaaaccccaatgaaatacaaccattagtttaaagaaagaaaaatggaataaaatatatgtaaaggtgtatccattccagcttatttatgaagaaggtaagatggtgtattgggttataaattgataaagtggctaaaattcgttggttgtttactttgtatttgtactgtggtaagtaaacatctggcaggtcttaacatgttttatctttataacaacaatatgagtaatagtatgttactgttgccattgtataaatgaggcatcacctcagaatcacacagctaatatgtgtgagcatcaaggatgacaccagtttattctgccttgaagccaataatctaatagttctcagtctgacattttcactgactgataatttaaaaaaatcaagtggtaaactttatgtgattattttcttttgtatagtaagaatgattgaaaaagtctacttctatcatctcaattttataaaagtggatattttaacaccaaataacatggaagaactgaatctcaaaataaataatagttatttaaagagaataaattaagctccctgtacatttttccacattgtactcattttcctaatttcacccaagactgatgaaaatttcatcacaaaaaatttcccgtagattgtgcttggatgcccatcttactctgaaccactgtgatatgctgcctactctatgcacccacacagctctggccggcatggtcatcatattcatgacttgatgacataatgcttatagcttattccattctcttcctagtttcaaataaaatttggacctaggaaagatgctagcacttgctttagccttagtttactgtgttaatgtttgttgaaatgattggaagattagggatgacttgttccttcttggtagttaactgccatttactgacactaagatggtgccactctgtgtcctgggattggaaatgaatattgggcaatgacaaaaagagcttgtcagaactaatttctccatcttccctccaaaaaacacatcccaacttgtacgggtcagtttgctccatttttacttctttgccttggcgaaagtgaagcaggtttggttagtgctcttgtaaaactggtggttggttttacatcccaggttgctttagatagtgtctatttgggccatcaaagaggaaaagaatactggtggagtgtgtgaaatgtggctaaattgacctaagacattagtttcatttctaccaaagcaggttgtaaatccaaattaccttgagtttatttattcattgtagttacaggtgttcaggtcccactgatacagagtctcatttaactgggatggatccacagaatctacctttatgcacattttcctatgtgattctgaggtgcagtgacatttcaagcaactaatctgcttgtagtatatcacttaacagatttatttaacaaaacacagcaattactatgccccagagttgttctaagtgctttgcagatattgattcatttaatcataaagaccttcaaaagtagattttattagtattcttattttagagacaaggaaagtgagtcacagaaaggttaagtaagttggccagtgtaagaagatcagtggaagggcaaggatgatgttaattttgataaaataattaaaactacctacgtgtgtgtgtgtgtgtgtgtgtgtgcatgtgtgtgtgtgttctgagacagagtctgcctctgttacccatgctggagtgcagtggtgcaattatagttcactgtagccttaaaccccttggcgcagcctcccaagtaactaggactacaggcatgtgctgccatgtcaggctaatttttaattttttttttttttggtagagacagagtctcactatgttgcccaggctggtcttaaactcctggcctcaagtagtcctcccgcctcagcctcccaatgtactgggattacaggcatgagccactgatcctggccgtgctttgagccacaaaacttgaagtagcagaattgaaaacagaacacagatttctatgtcttttccctatttgagtaagttttgcctttgaaagtgaaggaagaaaagctgatatttctcgagttggaaaatttttaaaaagtttatattttagaagttgttgcaccagataaataaatataattatgaatgggatagtaaacatggaaaaatcagagtggttttcctcaagtagtgtcatcattgacttggcctctaattagaccaaaacaatattaataatcagtaatacataatgttgcagacaagaatatttttaaaagatttggaaaataaacagctgtttgtttcaatccataacaaaataaccatatatacttcaaatacgtaactaagatttacatctttatactaaataagaaacaatttattttcctgtaatgctcctcataagatctttaagttacattaggaaatattcatatttatggaaggattggggaaattctacctaaatttatggattttttctcaataatttttgtaagctttgtataagatggaatatttgtaatttataatcacttgtgaaaactgatgtattgatctttaacaaagtacattttctcctttctgttatttaatatttttgtttaatacactaaaataatcttgtaaaatggcttttctttggtgttttttaaaatgaattttattttagaccgatgtttgattaaattatgtaaattatttgaattctaaacccccaataatgagtcattccacttgtgtggtttaaaaaagagttaaaaatcggcatttagaaacaatgtgatttccaattcagtaaatgatttaagggtttatggggttactgactattctactttcaagactcactaccatcttttctctttttcttatagcaaatttcaccaggattcctgagacttatatttcttcgattctcttgatcattcagtctcaaataggattatatatcacttgtcctgaaaaatattagaaacagtctgtcactgaatatggtgcagattttattcatatgttatagattttaagcataccttttgatttttttcttaaggtaaatactgtatttattattttttagtattctttttctttgctccatatcttgttctttgttcttctttccattcttcttcatggtgctttttgctttaaattgtctctcttttatgacttaataaatcttcatgtagccagactgaactatgtattggtttccttgattctggtaaaacaaaacaaaacaaaacaaaaaacaaaaaaggaaattaaaaaaggctgttcatttaatcatttagtttctgaataggtaagagacactatagctcttgcatctaggtcatttaacaggtggaaggggatgctaaatttgcatctcattacctttgtctacttttagagttgtgtgcttgggccctgtggtcagttggcaggtggcaggccatggctccaaaggaatgccgtgttatttgaggggatgccaatttcacttgccacacggttctcacattacttggtcagactttttaaaaataaaacaaccaatatatggttcattatttatgctagattactgacttcacatcaaaaatcattgtgatattgataggctgtgataaataattttaacaatttatattctgtggtacccactgtcagacttatggatagtatttcctctattttggtaacctagagcagacattttgtcaaaaatttttaaaagacttttattgttgtgcactaaagttgagatgaattgtaggtaattggatggtacagctgaattaacacattgaattgctagttatgagacacttcatttgctgttgcagacaacaataggcccatttttgcttctacaatgcacaaattcttattatctatataaaatgctaattcaagtgggataacatgtatacatcatttccattccttttgtaaggaaaactaacttccacaaatgtaaaatatttgcaaatatctcaaataattttgaacttcaattaatctttttttgcaaatgttaatcagttttctcattttccacaaacagaacaggatataaggcatttcaaacatgaaatcagtagtatcaattttaccctgtgtcccttaaggtctgtgcagatgggcaattcacatttatctcaacagagatccttatttgaatcattctgaagaacattattactatcatgattatggtgacatgcaatagtgtaataattttgttggctcttgggtttttttcatttagactttttaaagtatagcttcttcgttttcaatagatgagtatccattttaagaggaaggaataagaactatttttatctaaactatctcctgaaaactcattaagtcaagcattaaatggagggattaaaagttataaaactattacaaattgtagagagtaaaggaaggcaaaggaaactgcctagaatgtaggggggggtcgaggcagggggaggtgggttggtggcttgaagttgaggagattcactctgcccatattaagcccccaaaggcctgaggctcaataatgctgaaaaaagtaaagaacagaaatgagagtctggggctaaaacaaaataatttatcaaacatgtatagatgaaatagccttgtattcacaactctattttctatgtaaacatctctatagtaagtttttctcactcactcacctaactatccactcttaacatgtactaactagcaagggacagcaagggcaactaaggatgggtcttagaaaaacaatgcctcttttattttggcacttacagtctttaagcctaatgatcagctttttgcttgccctaaagcaaagtcttttagtcaacaagacccactcaagttcacagagatttgcactttttattcctttatattctttacttttttttttttttcttgagccagggtctcttgcccaggctggaatacagtggcatgatcatagctcactacatgtaacctcaaactcctgggctaaagcaatcctcctgccttagcctcccaaggaagcagggctacagaaatgtctcaccacacccagctaacttttataattttgtagaaatgggggatcttgctatgctacccaggctggtattccttcattcttaactacataaaacagcaatcaaggatcacagacatttaagatataatgtaggaacaaaaattttagaacgtctgcaacatgaaaaataaagagaccaagttaaagaaaccagtaacaacaaaatgactttgcaagaaacacacagaggaccataaaagagacaaatatatgttatttttatatatatatctatatatacacacatatatatgtatattatatatatatatatatataattcttgaaaagatccaggaaaatattgcattcataaaacaagtggatgatatagaaaaggaacactaaatgagtaagaaaaactcttggaaattgaatattttcaaatattttaagggaaaatttgtgattttaaatggagaaaaatctatcaattctaataaaaatgaaacaagatggaaaatatgagtcacagtgaatctccacgaagcatgacttcctaattggacgtctagtaagaaaacaaaaaatacagttagagcaacattaatgaattgaggataattatcaaatttctgaggaaaggtgatttacaactcagcataccatacccagtcaaaatatcccgtgtcagggtagaattaagacattttaagacatatgaagacaaacgttatcttctttaaatataacctttcttgaaaagttactccaggttgaacctcagcaaactatggttaagaaaaacagaaagacatggcatgatggctatgtgaagtagtccaggaaggtgaacaaattgtgttgtttcaacctggtataggattagtataaagaaatggagggtttggttggtgggaggatttgggacaaaaaggggacattatagaatatttaatgtttaaggagtatttaaaaagacaaaaaatgtacaaagaaaaaaagtagaaatgtcaggtaaaacaaaagaatatgcaaaaagggaaaataaccataggactttagttggctccaaaatgaataatatttttatattaaatatacatggtatttactgattttcatcttttgattgattttcagtcaatcttacttaaaatgtggaagataattgtggtgatagaacaaaatgcaaatattatcaagactgacaatgtcacgataaacatacaggtggctgaggttgggaattaggtatggggactggagagagttgaaggaaaggttagggattggaatagtagcatatcacaaaataggagtcaagagatagtgtctatagttaatataagaaatagcactgatatagtccttaaaattacaaagataaccaacaagaggaataatgactacattaggaggaaagatacagagaagttctgaatatgatgtgaagtgacttagataatggctaaactactttgagtttgcttggtcaaacttgctttaatttttttgaaaaaaaaaatgtgattatgcttcgatgagtgtgtacttcccagatttccacagattccaaccactctctgtggaggcatcataatccataaagatattgggatttaaagattccattgtagagctaataaacaattaaaagtgagttcctctggggagaggaactggttggggttgagggggtttactatataaagaaatataaattcttggcacttttgtcactgaacgtgatagcaataattccctatagtactacattatggggctaagaggggaacattggatttagtcctgataaagccattaataaactctataacatgtcatttaagttctctgaatgtcagtttcctcatctttaaagcaacaggtgctgggtttgtaatcccagcacttttggaggctgaggtgggcggatcatctgaggtcaggagttcaagaccagcctggccaacatggtgaaacccagtctgtactaaaaatacgaatatatatatatatatatatgtgtgtgtatatatatatatgtgtgtgtgtgtgtatatatatgtgtgtgtgtgtgtgtatatatgtatatacacacacacacacacacacacacacacattttttagccgagcgtcgtggcacgcacttctagtcccagctactcaggaggctgaaggaagagaatcattttaacccaggaggtaaaggttgcagtgagccgagattgcaccattgcactccagcctggcaacaagagcaaaactttgtctcaaaagataaaataaagtaaaataaataaaataaaataaaataaaaataaatcaactgatattaaaaagtccccagtaccactttgtagtctaatgtttattttgtgaagataggtctatcattttattgagaataaagtgaactagaatttttctaggtataaagcctaagactgatacagagctcttacttgctctgggtctttattagactaaaggtgttcattgccttcttaacaatgatcttcagtctctgtcctgtatcctttaagtttgattctttactttgtgtctaactgactttaccaatcaaatcagaatcatacatctttagttttatgaatgtgtgtaaccagatcctaaatagaattgttttaatagaacttttttcattcttcaaggccttattttcccacagcttaatggttttttttgctgatgtaaaaatgcacattacaagatgattgtttaaaagatcgtatctccatttcacctgttttcctaaacactttcaaagcactgaggaataatttgaaacaacattttatagtggattccagatagaggcagtacattttatagttctctctgtttttaaacggtaccagttactgtgattacctgatgtgcttgcaaatttacagaagaattggtaaatgaaggatggccatttcagtgttcacagatgtgaagatattgccatcttagatcagcagctgctcttgaaatgttcactccttagtatccttgggctaacactaattttgtagctgatcaaaataattgctgtaaagatactagctattcctaattaacgtgagcatatgggtagttcccacaaaaaaatttactaacctgccggttgttgctgtgtatatgttcatgctttagcattcttaactatgaacatgaatcagcaaactaaaaaataatcatagttagctttctatggatagaaatggagagagagacagagagagagaaagagagagaaatgaggaagtttccaaggttccccccatagtgtaggatacgtataccacaaaaatatattgtggaaaactgagaaaaaatactttatttaatttatgtggtaaaacctagtcttttatagtataaaaggataggggattctgaactgaaaaaaaaaaaacaaattaacaatgaggcactcttttttttttaaattatacttttaagttttaggatacatgtgcacaacgtgcaggtttgttatgtatgtatgcatgtgccatgttggtgtgctgcacccattaacttgtcatttaacattaggtatatctcctaatgctatccctccccactccccccaccccgcaacaggccccagtgtgtgatgttccccttcctgtgtctaagaaaatgtggcacatatacatcatggaatactatgcagccataaaaagcgatgagttcatgtcctttgtagggacatggatgaagctggaaaccatcattctcagcaaactatagcaaagacaaaaaaccaaacactgcatgttctcactcataggtgggaattgaacaatgagaacacatggacaaaggaagaggcactttttaaagctgtgaatatctgttttctcttgatagtttgtgattaccgtctctcttggtcccctcattttaccattttctgggtgatcttgatttgaggacagtaacttgtgggcagttagagctcttttgtcctgttattttatgtggttggtgaatctaaggtccattaagttacatattaaagttgaagttcttggcaattaattaggaccttttagcatattaacttcctcttcattctaagataagataaatgtagagattcaagttaggagacagtaaaacacaattaagtgttaaagacacaagtttaattttgtggtgcctggaatcacataaatgtagtttaaaaattcttatatctaattactagaagtatgacagaagacagttacatagcctgcatggaacttagttacctcatctttaaaatggagataatagtcatagtagataacatgaatacaacccaggtctcttactgggcaagaaggtctcttttaagtgctttacataacattaactcatttaattcttacagcactatgagctagatattctcatccaccttataattgtaatgacatgagagttgaggtgacaatgcatgaaatgtactgattgttgtgcttggcacttagcaggtgctcaataaatgtgagctgttatttgtgtatctcctctccgatggtcctctcttggtatctagtgtgacaggtgcctagtaaatttggcctgcttaaccgattttcgaaataaaatctaagacctggaagagttattgtaaggagttactgcaaaattgggccccaagtgccaataaataaataggagttaaagatgggactgaagccaagtgaagtagaaacagtaaaactgtgttagtgaaatattgagaaatcttacttgagagaagggaagataaatgtgtgaaggcaaaggtgcattcatttcatgataaatattatgatattatacacattatacacaatgctaaacaatgacctaccactttgcaaaaaagtgcatctagctgagaacaaggttgatatcttctatttgggaatttccaacatcaccgctgatttttgttaggtgttctgtgttaagtgacagccatcttgcatttcccccttagttatttgatctgctttgactatgttgtttttcttgtggaagaggcttagagaaattgaaagatcaatgctttttgtgtgtgtaaaatagagaacattttaaaacattgccatcccacccttcatttctgaatgaaaaagatgaaacattgtatatttcttattctttaaagacacagattttattttcggtatgtgatatctagtttttaatgatttttatacatgcttatttggagactttctgcttttttaatgtggaagaaagcataatttgaaataacaaattgtaattgatttcccatttagaaatatttgaattccacttctcttttcttatcaagtgaggagaatatgttttgagcactggtattttgtcatttccttcataataacttgtgcaaatgataattatacataaattaataaactgctggtgggaatttaatgatgcatcatactgtttttgatttatttccaaatcatttgcagaatgttgaaatgtacaaggactaagttttaaatgtaacctacaacttcctcagctccaagaacatattcagtaaaataaaatagttatttttaaaaatggtggtacagaaataaattgcattatgttttgtgagcttattatatgaggacattataggttattaaatagtattgtatttatctgtgtttaaaaaatgtttcatattgcaagtaaataaattatttttaaaacctattagaacttttgccatgtgattcaagcaattttctagtgctgcctaaaataatgttgggtcctcatttgcatttccttagtgctcctgtttcattccatcttgaagttttgtgtgccacttgaaaatactttaaaagtaattaaaaataaaattttgttacaagcttcaataactttgtaaacaatttctacataaaatatatttaaaatcaagtactaactcctgccaattctggggaccatgcatgaggttaaccattttcaaccaaggttacatgtactcacagacagacaattgattcattttcttgtattattgcatctatctgccaacatattacaccaattataattattttatttatagagtgatagtcaattgataattaatcctgtaagttcactttcagaacagtcttcattttattcaacaccaagcaccttggaagttagtaagtcacaaaagatgttttccatagttataaaatatttagcaatatgattaattttacagtgtattcttcacgagcatgaaatcaaagatacactgtttcctagcacagggcagagttgatgcaaactacctgtgtgtgtgcttttctgcaaagcgctcctatggaaagttgatttttcatttttctaagtttcctggcagtttttaagtgtggtcctccacgatcttggccttggacaccactaaaactaagtataaattattgatcttatttcataattcagattcattcttgactttcagttccttcattaactctagagtttattttgacctgatattagatcaaattaaattttgccaggtggattaaaaaaaaatgctccttatcccaaaccttacgttcagtataactttcttgttaggttctaatcagttttaagtttttaaccaccctcaaagccttcctgacactcttttatccttcctcaccccacactaacacactctaaaactactacatgtagtgggagttactttctgtctgtttgctttttataaaatctcatatgtatttattacttaccattgaaaaattttattatgtgattttaatcatgttgtattatatgcacttgccattttactataattcactaaataccgatgcacttttatttggccagaggcctacatctcacagtaactgggtatataaaattgtgggccagtaaaatgctgctacattttaatatagaaatgactgtactttattgatgcatgaaatgattcctgcttaagcagtcagtatacataatcaattaataaatgtagctagtgattttgagatctacatagtttaaggcactatgtaaatgcaagatcaggcacttccaatttattgagatacatacttaccagtgggttttcagcagtgggttcatgctcatggcatgcaattattgaatgctttttgcaattataaaaccctgggggtccactggccaaaatttagttttgtgggtgtgtctgcacttctgcttgcttcctgtgaagtgtctgccctactgaagtctcatactatcaagataattgttctctcattcttgcttctgagaattattttctcaatcaggaaagagtaacacctgcgaaatagagctacatgttttcatgaggctattctatcaagaaaggatgtctttgtaacataaacaaacacaaaaatcatctgtctatatgaacagtgttccaaatgtatgaatcatgaattacaaatgtataaattacatgttgttattttgtagaatttttagttttccttttctgtgttttagtaaatgtgttcatattatgttatttatggttgtattttatgggaaaatatgtgcctcattcattcacttatcactgtgcaggggttcaaggacagggagttttgttagtatcgacagttgtgatctcatgatatacttggctgattgccatcaaaccagtcactcaggggacttaagaattctgatctcatacacaatgtacttggtctcagggataaaattcacactgcaccccaacttaaaactttttcccgtgttgctttctcaatccaggttcacaccttctatttattagaaatggtatgagttcctgccttttagctgacacttttatctgggtctccctctgtaaggctaaatgcccttgttagaatggcacaacaacaacagcaacaaaaacagaagagaaaacaaaaggaaaggaaaggagcttgtatccccagactcatgctgtgtggtggctggtttgtttcttctttcttcagcacatcactcctgtgacatgctgtgcctcagactgcttgactgaccttgccgtttagagctgttaaacctgaatagagcagagcttttcttttcccttccagtaggtctcaggagtgagatctggtcactggcatttattctctgacccttaactgtggttccccttgaaatggagctaatcaaggtgttgttccacttatttattgatgctcatgaagcattcattgttggtacatataattttgcctattcctatacttgaataaattctttcttctacctaaactatggatgtatgtctacatctctttgctatttgtagattagaaaatccagaaaggcagtctaacagaattctttttgtgctgtacctagcaaaatgctctacacaattaagtccttactgcatgcatttagctacatgcatttaattagattgcatatgtacagataggtcccttgggccttccagagcagtagaggctactttgcaaaatgatgcaggccaaaaaggatttaggtcagtcaaatttttatctggctttcccagtaggatagttgaaactgcctttctacttgctataagaatgtcttccatgtgactttttttttcttctcaaattccactgttagctagtcagagattgtgcactttatatgcttcttgtcaaactcatttggtatttgaaatcacaacgcctttatgattttcacccaagtggcttcagagttctgccacttatgtcatttataagaatttgcctggaaattgtttcctttgcaggagacataagtcacagggtttaaaattgaaaaggatctcaagggctgattctgtcactcctgctagccctcagtcaaggttgtgcttaatctaaacccaagactaatatgtttctctaaaataaaactatgcctcatcattggtttgttaaatactctacattgtcaatagagggatctctgaatgagcatgtaactcctgggtgttaaaaaccttcaaaagctctacaggttaaatttcaaattctttagcatatcattcaaggtccttcttagagatctattccaaatgaccttttttggccttgcatctcactttttaccccctcttaatctactttcaggattcgctgaattgattctctgttacctggacttatcatagaagtccatgattgtttctttgctcacgttgctttgcagccttgaattacctagatgctcatttcaaagatcagctcacacgagcaaaaccttgaaggatttctccaaatccccaaggcaaaattattctattttctgtgttcccatagaaccttgttcctattgctgttgctaactttcaacctgttatcatagtggtgccctcacatgcctcccattttagatgagaagctttttcacaatggagacatcacatttctcattgttcctctgagacctaccaaagtccataatacaaccattcattctataaatgtcttgaaaaattgttaaatattgatgcagtaggataaagggctatgaatttaatgatgctctattgaatgaatctttgtgacatgccttgtatctttttctggaatataatgaggatataaaaatattaacataatctcttgcaatgataatctctacaagtttataaaaatcatgggtccaagattatgctaaaaataaaacccatttcttccatcccatgtttatagcacacttctagttggaccgttatttgaaaggccccagatttaaagttaggtttaaagatgttctaaaatgtcttcacttaaaaaacaaaaagacaaaattaatatctaagcaatctttaatttctagaaatttatttttacagtgtagtataagctctcctggtactgttaaagctatttctttacttataattttaaaaataacttttcacattactaaaaacaaactactaaacatttttcaatgaaatataaatttctttatttgggtcatttttaatgtatcctaattttccaactgttaattctttccatttctgtcctctgtcttcattttaaatatgattcgacatgtgaaccctaatgtatgctagccaaatactcattaaacccatgacaaaaacattctttaattttatctgcaaattcttagataatgtgtatcatttaggaattgtgctcagtgtgtatccagagtggcctaaagaaattggtactttatttttccctcacaagatatgaagtcttgatgttggtagtctgctaagatgacctctgtaatgttaccagagatcttggattcttgcattcattctaggattcttgtactcaaaatagctgtcagggttccaatcattataactacattttgaacaggcgaaggtcaaagagcataaatgtgccaatagcagctaagaaaggagagattagacactggcgaggcacctttcaggttcaaccacattcgtcaaaaaatcatgttttcttaacttttggaaaattgattttgtttcttacttatgttgcaactttgtactattttccagctcttttaatgttgaagttctgcctaacttatagctgtgtaattagttcttacctatgcactttgttgcttttgttcactttcagcttttaagctagtatttttttggattataacatgatatgtattttttgtggaatatttggaaaattagaaaaaatgtaaaaaagaatatgaaaattacttacatttttacaccatttagacgtaacaatgttaacatttcactgtatagtgaattgttatactgaatttatatacatatataggcacatgtatttacatatatgtaaattatgtcattatttacaaaacaactttattctccatattattttagaaattattgatattgttttgaagattagattttggaatataaataaatattatttgggacattatttttatgactacatggcatttcatcatatggacaagccataatttacttagttgatccctaattgttgcttttatggatttaaaattgtagcattataaatgacacggatgaagtactttgaacgtgaaattttgcctgtatatcttattatgtcttagaataacttgatggaagtggaatgggtcaaaaagtaaggatatgcaaaggaaaaggcagcatttcttcagaaactaggaaataatgaagcaaaaggtataaattatgccatgctttattgtgtgtttactgggaatggagtgcagtgaataaagcagaagtgttccagttttcatcccagaagacagaagagccaatattttctcctgtttcttcaggtagcgaggggccagtggtgaaggagctgtcattgaacactcttcacgttggctggtgactgcttggaacaatcattttgccacttctttaaacattcaatgaaaaaaaatgaaacaaagggaacaaagaattgacagacaacccacttgaatctctcgagaccccacttgagaacccacaggtctctggcctctcctcaactggttgaataaaaaggaggaatggatgatagagtattcagttaggaaatgcaacaacatggcacctaaccatgatgtagagactggatatggaattacgcagtgatataaattggctgatgaagtacagagaggttatgtttaaatattggttgtgtacaaatcaggggattctgatttgtcatgcctgtgatcgaaaatatcatgagatcattatgaagtagtatttacaataagaaaatatgcaagggagttagtggccttgaaggtcaaattaaaagagagagagagatgggggtgacagggagggaggaaaagagggaggacatactagggatgacttttgaagttatagattaatcagtttgctttgatatttatgaaaataataagacaaaatgatgattgatttccatacacttctaagagcagaaaaaatggggtaacagccaacatgtctgagagaagtaaataactcagagttaatgtaattttcttctctaacacaataacagaacttaaatatgagaggacaaaaagttcatatatctttacttcggtaaggtttagtttttgtctgacatgctgttctgatcaaccagcaaagaatatgtagtcttgtgtaaagggaggcatagcttgttacttgtccctgaatcagtgacctggtagagcaaacaaagtaagactaaaagtgtttattggggacttgtactgaataatatttgtaataatctccataatttaataatacaaaatgtggaatctacagactaggaaaattgctaaatctatgggaatttgcaggaatctaaagtgaatatgggaattaaaaaagagggactgaaataagttggctgtgtatgagaaccattgattaaaatggcattaaaaatggtaatatctagtgttgctgagacgttttgacacattgttgctataaattggtgatgagacctggaatagttgtttgtattgttcagggggatttgtagtgtttcctgccttaattacatcccttatcctgtaatgaccatttttttctatgttctgagtttcaagattgtaacacatcttcctctatttgtaagcatttttctttttttagctcaacaaaatgaataattattttactaaagttgctttgtttccatgcctttccgtataaacaatttttcatttcagtgttacctttttgtgtaatcttttagaagacattttgaaaggtaattaaactcaacatgtagaatacctagagtgcatacaactgaaatgaaggcatgaccatatgcagaactagggtcaagttggggcatcagcaggcaacaaacactttgtcatgactataactggctgcagtaattgtaaaatataacctgatttggaagatggtcaaataggaaagttgggtacatcagtttcataaaatatggtttaacaagttttaacagtctcatgctacttgacccagaaatcccagttctgggcattttatcctaaggaaacaatcacgctgtggcagaagatatatgcacaaggaccttcacagtaacttctttttgccacaaatatttgatgataatttatattcagaaaataagtaaatgatggcatgccatagcaacaggatattaatcagtgatcttgcagtgtaatgataaaaaaagatattgtcacacaagaaattcacaattaagtaaaaagagaatataatcataaaatagtttgtatgatataattatttaaataatagtctgcgagtaagaacaggatagttgtttctggaattaaggatgattttatatttttatgttttttcctaaattaaaaaaaacttgccactttcgatttagaaaactaattgtataaggaaaaaccacttatattgctaatctttaaagactgataaccttttgtcttttttctttaagtcctgactactttcacttattttttgattaccattttattatttaactttacattgcttaattttctgactataatataatgttgtttgtgtgatttattttaaaactctaaagttggttttacatttgttctcattctcctgtattttatatatttaataggtatatatcaatgtgtaaattatgaataaatatatctttcatttaatctgaatatataaatattaaatatatatgaagatgtaaattgtatatacataaacactaaatgatatatagtatgtaagctatcactctggatttctcactatactaattattcaaaaacatttatgattttgaattattttttaacctttactttttttctgatttatttatttttaacttttagcttcaagggtatgtgtgcagatttgttatataggctaattgtgtgttacaggggtttggtgtacagattatattgtcacccaggtaataagcatagtacccgataggtagttttttgatcctcaccttcttcctacctttcagcttcaagtaggacccagtgtctgttgttctcttcttaaaaatactttctcgatatatgtttgaatattattctgtaattcctaaatataaatgtctagattaaaataaaaccttttatttttatttttaccttgttgcataattttaaattttgacatactttcaaatgtacagaaaatttataagaattgtgtttaagaataccttttgttcagattcaacagttgtttacaattttgcctcttttgcttcatttctgtctgtgctttctctctatgtgctcatgtgtgcatgcacacgtgtagacacaccacattttttttcctgaatcatttgagaatcagttgcagacatcatgcttccttaactgaagtgtttaagtgtacatttcctaagaaaaagaatattgccctctataaccggtgtgtaatttttaatgcaatattcacaatatattacttgtattgtgtaactcccagtatatttctaggatcccaggtgtattttgttgtcttatcattaaaagtccttttatctggaacatttcctcagtctaattacttggtcattataagagttcagatcagatatggagcgcaatattctcaatttggctttactgaatgtttcctaatggttaattctgttttgcatttttgacaggcataccacaaaagtgatgttgtgttcttctcaagtgcatcatacttggaggcatgtcgtatttgtctgattattgatgatgttgtctttgatcaatttgttaaggtggtctctgccaagtttctccactactagttactattttccccattgtaattaataagtaatttgtgggaagatacttttagactggaaataccatgtttgtcatcacactttcatgcgctggtgctgatccactaatgttttctttactgattcaggtacctaaaatattatggtggttttctaactccatcagtccatctatactttttagttgacattatactcgaagaaggagttttcccttcttaatttcatactttattatattttccttaatacagtttaatccattacaataattatttatttcccagttgtcccagattaaaccagtaaaagcctcttgaagctaggacctgtgtccttttgacatattcccatcattttataaatgccttacttgcttttcttccagaaaaaaatgccacctcaaatgtcatgtatttttaagtcttctctctgtgtccatgttctaatatgccagaatagtttttcagaattttcataggttgagtggattttttgtgagtgattttcatgtcactgttaggaattctggtatcctttacctttttcacagtttttctggaccccatatatctctgtatatagtgggagcttgaaagatagctctgttagaaattggtgtctaattttctgtttacatacaatctgacatgtttattattctccagcttccaattgtgccgaaggacttggatttgtgtgttttaatttgtttttttaggtgtatatattttttaggatatgtgaacagtttcagatttaggtggctcctactacctgagttcctcagaatgccagtccatatttttatgcattctgcaaaatatattgatatttgaagacaattgcaatatgccattgtttaaccaaaatttatggattgtatagctttacctttagctgttagtgttatcttaatccagtttatccaattaaattgaagtgtttaatgtatcataattattttattacatagtatgcctatcaatccaggaaatagctctctgaaaggcatgtccatggtaaatgtaaaattattatatgaggtctcattctttcacttgatgatgtactaatcaattgtttgtaatatttttcccttagctatgaaaattatcaaatatatatttaaaaaataaaaaatattcaaacccacaaaattttaaaacatatatagattgaaataagataaccaatcaatagcatgtgattataggaatctagtgaaatgtagtattgtaagtggttatttcaattgacaaaatacagtttttgagaataataaaggtaaattcttcctccagttgcacagcaaaaaaaaaaaaaaaaaaatgatggcaattcttaataaaggagggcttggatctggtggaaaacactccagtatttaaaattgtcagagtaaaagatggtttgtaaaagtaggaagtagatgaggggcaaccatttttctgttccatacctgagtctagccttataaaaatcttcactttttcaaaaaacctacatataaggattttttatgagaaatcttctgcttttgaatattatgtaatattttaaaaaccatggtgtgggacaaacgaaatgtatcagtaagccagatgtggttttcatgcccccagttttcaatctctgctctggatgcaacctagaaactagcagatattgcggtaagatgaaacccaggtcagaaaagctggttttgagcccaggcttgcctcctattggctgtgtcagattgagcaagtgatgtaattagtgttcacctcagtcttcttgtctatgaggatgaatatgctaaagtatgaagaaatatagagatttactaattgttataactttataattgtattgaattatatgtgaagaagaatatatatcttttattatgttttaagttttaaacttagaaaatacaaagtttcttgggcatttcttgatttttttccatttaactataaacttgctaactatatttagttttctctgtttgagaggttctgtgtgaaacattagcaaaatcatttattcatgggccaggtagagacctgtgcaatcccaatgtctttaacatactagaggaagataaattagattttatattcaaaatgcttggtctgaatattgaactgttgatttggttacagttggttttggtgaacacaaaagcacaacctctgtattatttaactgctatttctgcttagtaccatcaagacccagatctctcagcagaaattctgtttgttgctgagaacttaatattcctttaaagatgtttggtacttaaggggatttttatttatattgttcatagtctgtctgatctgtctgaaagaacacactgtatttttgaagggagatatatacatatatatatatatatatattttttttttttttttttgagatggagtctcattctgtctcccaggctggagtgcagtggcacgatctcatctcactgcaacctccgcctcctgggttcaagtgatggtcctgcctcagcctcccgagtagctgggactacaggcactcactaccatgcctggctaatttttgtatttttagtaaagacagggtttcgccatgttggccagactgatattttcattaggttgtattttattatatgtctttgaacagttcttttataacaccgtatatactccgtagtgtaaaacccatttaatttgaaatattttgagattcaaaatcaatatgctctttcaaaaccctactctaaaacaaattaattaataatgcttgattaaatcactttctcctcataatcacattgatattctgaaacacagagaatggaactgtttgtgtatttttgtggggtatgcaggtcgtgtgcctgcatttttctcagtgcatggatttcaattagaatttaaatgcagttacaaagtgaattggtgcaactctctggataaatcaagccaaattcttttctaactcagtgatcctcatatgtcagataatagtaccttttaaaaacttgaaatatttgaataatcacctcaactctccacgtatatttacttatgaacatctcatatttttgaattacttttatgccattctgccaatattctggggggcactgtgtttcttgcatataatatgaagctagtatgcagacttctcttacctctttcttcaaagtgttctccttgactgatgttttggaatatttgcatatagttgggaatacttctgttcatcagcccattatactttggtagatatatggtctacattttgtaaaacctatttaagcacgttaaagtatatagtgtttaagtgtgtgttggtctgtattagtttttctgtgatcttgacaaattgtttactcttttggattttttcttcctccacagatgcatttttgtagaagcattttgaggatgaatgtttgcaaatcattttgaaattgccaagtgccacatacagtaagtaatatttttatttttctactcaattgcagtcatgttcgattaatttggcagacagtcatgaaagaacccatttctatttacagtctttgatattgtcaacattgttaaagataagaaggttgtatgtgtgcagcattatttctggggtctttattctgttccattgttctgtgtgtctctttttgtatcagtgccttgcagttttggttactacagccctgtggtatagtttgaagtcgggtaatgtgatacctctagttttttctttatgcttaagattgccttggctattttggctctttttggtttatgaattataaaatagtttttcctaattatatgaacaatatcgtttgcagtttgataggaatagtattgaatctgtaaattgctttggacgtcatgaccattttatcaatcttgattcttcctgtccatgagcatgggatgtttttctatttgtgtcatgtctaatttctttgaccagtgttttgttgagaactttctcctccttggttagctgtattcctaggtattttattcttttgggggttactgtgagtgggattgtgttctcgttttgctgtcaggctagaaattgttgttgtagagaaatatacctctgccctgatgaagtgttctggccaacactacccatcagagtaaatgagtattttgtgactgaatttcaaatttaaaaaaataagaattgccttatattcagtgtcaatagaaccaatcagcaacccaaaatgagttgccttgaacaaaatgctatttgattagagaaaacttaaaaatatataacagctcctcccctaatggcagatataataccttactcttctattatacttttcagcatttgcagtggctgaccacagccttttcttgcactcctttttagttgctttttgcagtgaagaagagattgcaatgaagggttgagcttgacttaccattctcttccctctttattatcttcagatgtgtagtgttcatagtactatcctttacatcacactggccacattgatgctttcccttttggactctggtgatcttcaaattctttcacgttagccatccattggtcctaacccctgtacactttatttcttgaaacaaatcatcagcaacattttatctggggacattttcagaattactagtatttaaaagattattgctctaaaattgaatggattaaatcgttcatgctcccacactacttttggttttgagactgaaggatttacagagggatgagaataagagatgaagtctccatttctagatttgacctctggaagacaaagctagtgattttgtttagtaattttatttcctttggttcaattaatagtccatgctcctaaatgtgagaggtactgtgttagtaaggactagagtaagtgggagagaaagacaaaaagaactctcaaggaaactttgtcattagtttgaggaaactatttttcctcaaactaggaaaaaggtatttttaaatgttattctggtgatatcttcaaactggattgcagttggaagacttgttgcaaaaagatcaatttttaagcatttgtagagggataagaatgaagggatgagggcaagacctaaggtcatagcagtggggatggactggcaggggttggagcatgtgagatttatttggaagtaaacaggttcagggagtaatagtaataattaatgcttgtgcaggattcactgagtaccagggttgttttaaatgttaatgactaatgtcatccccattttgtgcaagaggaaactgagagaggcatcatttaagcaaattgtcccaggtcacaaaagtaaaacataccatgcctgacatttggggccatttagtcaagctccagagtcattgcagtttaccagtgtaccatcatttatctaaaaaaataactgaagcttccaggattactgagctggaaaatgatgttgccaataatcagagaaacatattttgtttacagagtttaccctttctttagataggtttttggatagccagaaaaatcttgacctttagggagaaatgtaccttatggttagtgataaatctcttgtatatattcacttgttgggcaatagcaacagtaatttattatattattcaattataagttacgatagtaaacatgtcatcttaatctgatttgtcttccttccttagtagaacttaaaaatgaaacaaggatagagtggtaaaaaaaaagattttgtatcttgggtccgtaaaagaacgcattttaaagttagtttaccgatcatgcaaaactaattttgacgagggaaaaacgtaacactcagcatatggagtatctctttttctattaggttaatgtaaaagtaattgcatttttgccattactttgcaaaaactgcaattacttttgcatcaacctaatatactggagaagtagaataatatactgcttaagaccatggtctccaggaccattctgcttcattgattcatgttccaagtaaggcccatttgctgtgtgactttgtgtcaattattgatgctctctgtgcgtcagcctctgtaccttcaaaatgtgttattaatagtactgtgtcttctggatattgtaaagcttaaatgagataaatcacctaaatggctcttggtagcagcgaattttaaataaaagttatgtttattaaaatttatctcaggtaacagttttctatttttcaatttcacctacataattattactcttttaagctttttgctttgaatttttacgcattaaggagacagagcaatgattttcacaagcaaagacccatgtaaccatcccacaggtcaagaaatagaacaattgctgcatctccaatcctactttttctgcctgccagccattacctcctttccatcagtttcccgtggatgacattattcctgatatttgtgggaattacttccttgcttttcattatagttttaactttaaataatgtatccttatatgcaaaatattggtttagcctgatttttaaattaatgtacataatattcatatgacacacattcttcagtgtatggtgtccttttctgaatgtatgtttgtttttaagtttctttaatgtttttgtgtggttcattaattttcattgctatatagtattccattgtatagaaatactacagaatatttattcattgtattgttgatggacatttgtgctctttctaggtttgggccattacccaaatgtaatgctgccataaacattcttttaaatgtgtttttgctaaatatgtacatatatttctcttgaatatatacttagcaatggaatttcttagtcatattgcatgcaatctttcaactttagtagatactaccagacagtattccaaagtaactatactaatttcacttcattcattagtgtgtaagagtttccattgtttcatctttaccaaagattagtataatcatttcttttaattttagccattctggtgagagtttggtttacattttcttgttgattaatatgattatgtcatgtagcttaatagccatgaacatattattgtctataaatttcctgttcatatgtgtatttttctattgtgttgatttttaaaattgttaatattcacaagttagttacactagattaagagcctcccatcagttaaatatgctgcaaagttctccttttctatgatttggtttttcaatttcttaatgaggtttttttgatgttcctaattttaattttaatcattatatcacctcattatgtttatatctttccacttgccttcatttttgtgagtgatgtgaggtagaagtcaagttctagatatccagttgttatagaatcatactggacaattctctccttcgcccactgttctttaatgtcatatttactataaattaaatttctatatatgtctgggtcttttaggagccaacttctatttaattggattattagtctcttcttaccacttataacactattttaactatggctactttttaaatattcttaatatctattaaaacaagttcttctaccacatgttattcaaaggcatgttgactttgccttctttcatgtaaattttagaattactttgtcaagttaacaagaataattgtttagattttagttagaattgcattcaatctattgttaagtaaatttttaaagagctggtgtaattacaatattaactgatttcatttatgaacataatatatacagcatttcctccttattaactggggacacattccaagatccccagtggatgcctgaaactgcaaatagtactaaaccttatatatagactatggttttttctatatatacatacctctgataaagtttaatttataacttaggcacaggaagaaattaacaacaactaataataaaatagaacaattataacaatatactgtaataaaagttatgtgaatatagtctccttgtctctcaaagtatgttattgtactgtacttaacctgcttcttgtgatgatgtgagataatacaatgcctacatgatgagatgaagtcttgtgaatgattttggtcataactttcatagtttgaggtgcaacagcaaaactaacataaatctcttgttctttcttcacaatttcaaggacagaagaagcattcttaccatagagcttagcaacgtgagcaaacaactttttccctttattattttcttaaaggaaacactttatggcttctctttggcatattcaaattgccaacatcaccagtcttgtaatttgggtccattattaagtaatataacggtgacttgaatacaaacactgtgataactttagcaatcaatctgataaccgatatggctactaagtggctattgggtgggttgtgaatgtagcatgaggatgctggacaaaggaatgattaaagtcctaggaggaatagagcagagccatgggaaatttcatcaagctacacagaacagcacaccatttaaaattataaattgtttatttctggaattttccatttaatatttttggaccacagttgacgatgagtaactggaaccatggaaggcaaaaccataagtaaggggggacttatttattttgatcttttagtttctcttaatcccatgtctggttgtttttttttaatgttgagttcaagctaatttttctttttttctttttttttaaattttattattattatactttaagttttagggtacatgtgcacaatgtgcaggtttgttacatatgtatacatgtgccatgttggtgtgctgcacctattaactcatcatttagcattaggtatatctcctaatgctatccctcccccctccccccactccacaacagtccccagagtgtgatgttccccttcctgtgtccatgtgttctcattattcaattcccacctatgagtgagaacatgcagtgtttggttttttgtccttgtgatagtttgctgagaattatggtttccagtttcatccatgtccctacaaaggacacgaactcatcattttttatggctgcatagtattccatggtgtatatgtgccacattttcttaatccagtctatcgttgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgacttccacaatggctgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcgttttttcatgtgttttttggctgcataaatgtcttcttttgagaagtgtctgttcatatcctttgcccagtttttgatggggttgtttgtttttttcttgtaaatttgtttgagttcattgtagattctggatattagccctttgtcagatgagtaggttgcgaaaattttctcccattttgtaggttgccttttcactctgatggtagtttcttttgctgtgcagaagggttttttgtttagaggtcttatgtattttggttaatttgtgcctagaagtttaatgcagtttaatattaagattatatatatacacacacacatataattatatacatatgtatcatatacatataattacatacataataatacatacatattatatacacttttttaacttttattttaggtttaggggtacatgagcaggtttgttatgtaggtaaacttgtgtcatgggggtttgttgtacagattattttgtcactggaatactaagcctcgtacctaatggttatttttttctgttcctctacctcctgccaccctctatcctaaggtagagttcattgtctgtttttcccttctttgtgtccatgtgttctgatcacttagcctccacttacaaatgagaacatgtggtatttgttttctgttcctgccttggtttgctaaggatgatggcctccagctccatccatgttactgcaaaggatatgatctaatttttttgtgtgtgtggctgtatagttttccatagtgtatatgtgccacattttctttatccattctaccattgatgggcatttaggttgattccatatctttgtcattgtgaatagtgctgcaattaacatatgtgtgcatgtgtctttatggtaggataatttatattcctttatgtatatacccagtaatgggattgctgggttgaatggtaattttgtttttaactctttgaggaatcatgacattgctttccacaatagttgaactaatttacactcccaccagcaagcagtgtgtaagtgttccctttcgccacaaccttgtctgttctgttatttgactttttcataatagccattctgactggtgtaagatggtatctcatggtggttttggtttccatttctctaatgatcagtgatagtgagctttttcatgtgattgtttgccacatttatgaaaagtgttggttcatgtcctccgcccactgtttaatggggttgtttactttttcattgtaatttaagttccttatagatgctggatattagagctttgtcagatgcatagtttgcatatatatttcccattctataggttgtctgcttactctgttgatagtttctttttctgcacagaagctcttcagttgagttagatcccatttgtcaatttttgcttttgttgcaattgcttttggtgtttttgtcgtgaaacctttaacaggttcttcatccagaatggtattttctaggttgtcttccagagtttttatagttttgggttttacatttaagtctttaatccatcttgagttgatttttctatgtggtataaagaaggagtccagtttcaatcttctgcatatggctagcctgttatccaagcacactcccattgaatagggagtccattcctcattgctttcttttgttgactttgtggaagaccagatggttgtaggtgtgcagccttaattctgggctctctattctattccattggcctatatgtctgcctttgtaccagtaccatgccatttttttattgtagctctgtagtatagtttgaagttggtaacataatgcgtccaactttgttctttttgctgagatatcttgccttggatatttgggctcttttttggttccatatgaattttaaaatatatttttctagttctgccaataatgttatttatagtttgatagggatagcattgaatctataaattgctttgggcagtatggccattttaatgatattgattcctcctatccatgagatccatgaacatggagtgtttttctatttgtttgtgtcatctctgattgctttgagcagtgttttgtgattctcattgtagagatctttcacctccctggttaactatattcctaggtattttgtcacagttgtgaatgggattgctttcctgacttggttctcagcttggctgtcattgccatataggatttttaatgtgatttttgtacattttttgctagtttgtacagattttgctagtaatttttgtacattgactttttatcctgaaactttgctgaggtttatcagtttaaggagctttcaagctgagattgtggggttttctagatacagaaacacatcatctgcaaacaggaatagtttgactccctttctttctgtatgtatatgctttatttctttctcttgatggatctctgtggccaggactttcaatactatgtttaataggagtggtgagagggggcatccttgtcttgtgtggcttttcaagggtaatgcttttgcccatttatgtgatgtttgctgtggttttgtcatagatggctcttactattttgaggtatgttccttcaatatgtagcttgttgagagtttttaacatgaagggatgttgaattttgtcaaacatcttttcagcttctattgcaataaacatgtggttttgacttttacctctgtttttgtaatgaattacatttattgatttgcatatgttgaatcaaccttgcattccagggataaagcctacttgatcatggtggattagctttttgatggcactgctggatttggtttgctggtattttgttgaggattttttaatctatcctcatcaagaattttggcctgaagttttctcttttggttgtgtcactgcaaggttttggtatcaggatgatgctggcctcatagaatgagttggggaggagtccctcttcctcatttttttggaataattgcactaggaatggtaccagcccttctttgtatgtctggtagactttgtcggtgaatccttctggccctggctaggcttttttttttttggttggtagactatttattactgattcaatttcagaattcattattggtctgttcatggattcagtttcttcctggtttagtcatgggagggtatatgtgctcaggtatctatccatttcatgttgatttttgagtttgtgtgaatagaggtattcgtagtagtctctgatggttatatatgtgtgtttctgtagggatagtggttattgcctttgtcatttctgattgtgtttatcttctatctttttctctttattagcctagctagtttctatccatctttttaattttctcaaaatgccaactcctggattcattgatcttttgaatggtttttttatgtgtcaatctctttcagttcagcattgattatgtttgtttctggtcttctgctagctttggagttgatttcttcttgcttctctacttcttttatttgtgatggtgggttgttaatttgagatctttctaagtttttgatgtgggcattttgtgcttcaaattttcatcttaacaccgccttatctgtgtcccagagatcctagtacgttgtagctttgttcttattagtttcaaagaccttcttgatttctgtcttaatttcattatttaccccaaatcattctgaagcaggttaatttccatgtaattgtatggttttgagtgattttcttgaattctctttttttgtgtgctgttgtctgagagagtagttgctatgatttcagttcttttgcatttgctgattgttttatgtcctattgtgtggttgattttagtgtatgtgccatgtggcaatgagaataatgtatattctgttgtttttggatggagagtcctataggtatctatcaggtccatttggtccttttgagttcaagtcctaaatgtctttgctaactttccgccttgatgatctgtccagtactgtcagtggagtgttgaaatctcccactattattgcatggaagtcgaaatttccttgaaggtcactaagaacttcctttgtgaatctggatgcttctcagttgggtgtatatacgtttagaatagtcaggtcttgtcaacctgaatcctttaccattatgtaatgccctcttttgatctttgttgatttaaagtctgctttgcctaaaattaggattgtaaccctagtgtttttatgttttccatttgcttggtagacatttccccatcccttaattttgagcctgtgagtgtcattgtatgtgtgataggtctcttgaagacagcataccactgagtcttgcttctttattcaccttgccactctgtgtcttttacttggagcatttagcttcttatattcaatgttagcattgatatgtgtggatttgaccctgtcgcagtgtttttagctagtttttatgcagatttgtttttatagttactttatagtgccacttgtctgtgtacttaaatgtgtttctgtagcggctggtaacagtctttcctttccatatttagtgcttttttcaggagctcttataagcgagtttggtggtaatgatttcccttagcatttgcctgtctgaaaagcatcttatttctccttcgcttatgaagcttagtttgtttgtatatgaaattcttggtcagaatttatctttttgtaagaatgttgaatatagacccccaatctcttcttgcttgtagtgctgtttctgagaagttggctgttagtctgatgggcttccttttgtgggtgacctgtcctttgtctcttggtgcctttatcattttttatttcagccttggagaatatgatgattatgtgtcttggggatggtcttcctgtgaagtattttgtgggggttctctgcatttcctgaatttgaatgttggcctccttggctagataggggaaattcttatggatgataacctgaatcatgcttcccaagttgcttccattctgcttatctctttcagggatgtcaatgtcatagatttggtctctttatataatcccatatttctctgaggtttggtttgttcctttttattcttttttctttattcttgtctgactgtattatttcagaaagtcagtattcaggctctgaaattctttactcagcttggtctaatctgttgcttttacttgctattgcgttatgaaattcttgtagtgtttttttcagctctataaggtcagcttcatgcttttctatactggctattttgtctatcagattctgtgtcattttattatgattcttagtttccttagattgggtttcagtgttttcatgaatcttgaaaatcttcattcttatccttattctgaattctatttctgtcatttcagccatctgacctcagttaacaactcttcttggagaactagggtggtcatttggagaaaagaagacactcttgctttttttgagctgtcagagttcttgtgctggttctttctcatctttgtgggtctgctgttccttcagtatttgaagttcctatcatttagatgtttttttttcttttatcctatttaatgaccttgggggtttaattgtggtataaggtgtattcagtcaattggattcatttctgcaagattttagggagtcaaggcttagctcaggactcccggactgtgttttctaattctgggtgactcttattgggcactggctttgttttctggcccctcatggttaggaacctgttgcacaggataggctgaaatgttcctgaactgctggtcacaatacttgtatgcatggtgccagccaaagctctttgtagggcagtggcagtggaatctatcctcatttgcatgtgctagcaacagtggcagcagcagcatggccaagtgcacacttgtcagctgtggcagggtggtagtgggtgctgggtagccagcaggtgtttgcagcagtggtgatggcagtattactcagggagacaggggtcctccactggcaactgtgcatgtgtttatgccagtgttggtgttagcatggtggtgggggtgctggtgggcgcaggactgtgcatgccctctatgcatgttcacactggtggtggtggctgcctaggttgtgggcaagctgtctgttttccctgcctagtttcactttggcagcagtgtcagtgcaagtggtgggtgctgctggcagcagggcaggcggctttcatgcctgccaatgctctgaggacaatggcaatgtgacaggtggggtggggggcagcatgcatccatgtcaacagcagtggtatagcagggtgcgtgcacacacatatggtggcagggaaaggaagggaaggtttgtctgtgcacacatgtcctgtctcatgggcaaaacagcccttcagagttcaggttggacagttcccctaaggctaaagtctcctatggaagcaagttgagcccaggggaatgggcagccctgaccatgctccgctacagacactccaacaccaaatcctctgggctctgcattggctggagttctggctctaacacttttctaagttactctttctgccaactgaagggtccatggtggtagaggggtttcctactgctgggattccagagggctgtgatgagagcagcttgctccttgtgtgttcaactcctactttctgcaggagttcttcggggccaggaataagtcctggtgaacggcagtcccatgcagggtgcccagtcccctctcccttcagtccagcatctgtgtcttccctccatctgttctcaatgccttgcctctgaagatatgctcagaggactccagtctttctgatgttctggtcccttggagggagatgttcctcctagctgtgtctagttggccatcttggggtaggcaagatatatcttaaaaaattattttctctttgttccttgtataaaaatacatgtttaaatatcgcccttgcatatagtagattgtaaactcattaattctagtgtgtttttcagtgcattattttgaattttctatgtaaacatccatgttgtctgtgaagaaagatagtattacttaacactttcaaaatcttatagctttattgtattttctgtgtcttattgacttggctagaatgtccagaacaatgctgaatgaacacaggaagaatgaacattctgctcttgttcacaaatcaaagagaacactgtccatcattttactgttaagaatgatgtccttgaggtcaggagttcgagaccagtctggccaacacagtgaaaccccgtctctactaaaaatacaaaaaactagtcgagtgtggtggtgtgtgcctgtagtcccagctacctgggaggctgaagcaggagaatcatatgagcccaggaggcaaagttacagtgagctgagatcacgccattgcactccagcctgggcaaaagtgcgagtctccgtctcaaaaaaaaaaaaaaaaaagatgtttgctgtattattttgagaaaatagcatatatttgattgagagaatctagttttattctgattttgttaggattcttaattatagttaggtttttaatttttatcaaatgcttctgcctgtattgagattttcaaattatctcaaacctattgagattatcaaattatctcttttactttcttatccgatgatttatattgatattattccaccccccaacccccgacaggcttctttgcttagtatggtacctggggcacatgatagttttttcagtgttttttttccaaccctttccgtcttccttgcatgtttgcataggggaggaaacctcttattacattctggacaatcctccagtggtaaattgctgttgcatactaatatactactcctggtgggggacaggagggtgcctggatcctgttctccagtctttatcttagacatggcctgtgcacctgtgccttagatgtatggctcttacacaatacctacccattcctcccatggggcccaagctcctcctggagtctgtgggattcatgagtgggagaggtgtcctgctcttcccccagtgttagcagacctctgttttatgttagcttaagattctgggcacaagaaagttacctgcccattcagcaaggtttgatggatcattctaccccttcctgagaaactatagctcttttccagggtgttgggaatatgaggatttttttcaccctaaaaggctaaattttgctttgtattagagaaaattttggggaattggtaaggattttgtgactttatacctccaaagagttctcactggtctctactctggactgaatctttcctcataaagaagtttatgaatgaacacatgtttatttgtatataggggattcctgggtgtctacactgttctgttggccaattctgatccttaagtatttgttacacttttagctgttttcttcttacctactttcatggtgactacctcattctctcttattctgttaaaagtgaaatagttcatatgtcctgtcactcctcagagtggctgttaccctctgaaattttgttcatctctttgcctggtgacccctgccctctgcatagaggaagcctgatcattatcatcatgggctgaaattatagctcctagatcattaggaatctagtctccttttgtagttcttttccacagtcttagctacataacttcatccacaagagttttccagtagtttgagatgacttctgcagcctagccatcacatttgtgttctatgcagcaagaatgaaaaaaaaatgcaatgacaaatgaggcatgcagccaggtgatttacccctcatcaaagagattacctggaaactctttcttatattttctacctacccatcattactcttagttgtaaaggagactgttgcacgtagtgttgtagctgcacacacaactgttttgttggttacctagtaaggatgaagggaaagatagatatttagtaagctcttagtggtcatagtcacaaggagaggataggaattacattgaggtgatctgatcttttcttttctttttccttccttccttctgtccttccttcctcccttccttccttcgttccttccttccttccttccttccttttttctttttctttttttttttttataaggtcttgctctgtcacccaagctggagtgcagtggcacaatcatagctcactgcagccttgacctcttgtactcaagcaattcccttcctcggcctcctgagtatccgggatgattggtgtgtggcgttgtgcctggctaatttttaaatttttagtagcaatgaggtctcactatgttgcccaggctggtctcgaactcctggcttcaaacgatcctcctgcctcagcctcccaaactgctgggattacaggtacaagtcactgtgcccagcctaggtaatccgatttttgaggcaggatggagtgagttaaaatgcacaggttctaacatcatacagaactattctgatctcagttcagcaaatactagctgtgataccttgagcaaggtttttatttggttatacctcctcagctgtaaaagggcatgatataactgtgtttaaatgtttcggtgtggatagaatatgataatatattcaaagggttcattgcataggaaatagtcaagaaatggtatatttagtttacctatcttatattagcataaattcagtttaagagaggacggtgtctataaatgactaatacagattgatagagtacaaaggcaactaaccttgtttctcttgagtagagctttaccttttagatgggattgagtctcaatttctgttctttgatgtataatttctatactttgaattaaactgaaagattgctcaaagttaaggtctatgatagcagcactttatgtaatgtcaaaccaagaaatagataagaatttaaaggtttctctttaacctttgccattggtaagttatgaaactgacgaaagaaattatacacctctgggcctcagtttattcagctgacaagtcacttagttgatgagatgacctctaccacctatttaacagctttaaaacaccgtaattctgtgcattttttttttgcctaacacagattcttttgccaaaagaaatatccttgtctctgtttgtgtctgtgtgtatgtatttattcatattgccatcatctttaaaatatcttgaatataccatatgtgtattaagatgtgtaaagtacactaatattaaatatatggattgatgggtttttacgtagttatatgcctgcattactgctacctatagcggtaatatagaatcaggaacacacagaatatttctaacccccaataacttccctttacatctcttccccatcaataaccttctggtttttattattttttattttgactttatgataatataatttgaaaaaggtatgcattattttgaggggtaattcaaacttaaaaatttttctagaagtattaacaattatgataaaaccaaaaacgtctaaataatgctgaaaagtgcaataaactataacaatgatgttataagtaataaacttaattgcacatccactgaaatgaaacagaattgcagtgtgaaaaatctcttaaaattctatccaaatctcccacctgtaagccaaaaaatagagctaccacacaggctggtgagtattctatcagtcatgttgccaggcaaccttagtcagtatgagagacacccaattgagcagccttggagtcaaactaaaaggtatcttggaaacaagggttcaactgatagagagggaggatagaagcagagagagagagaaaaaagaggcagaatgtcaattaggcagttatctgttaatcatgaccacagtttttttttttttctagtaaaatgcagctagcttacagcaaaattacttggatttctacttccttctctctgttttctcctgcatgtacacatgtgtgagtgcagaggtttggcaagatgtatcatcattacttttttggagagaaggatgttcaaaagcatttttagcatactcaaaacatgttaactaggagttcattgagattttattaattcaggattatgtttgattcagccaagtttaaaataattaatctgatttttaaattgaaatactgtgtttgaaaaattgggaatacaaagtaaaaatatctttctaccacttgaactgaaatccttggaaggtaaaagaaatggaaagggagatgctcctaattctctctgggtgaacttcggtagagataacatacaccaatcaaacagggtgagaatttgggatgacaaagtcaagtaagcccttgactctgcaaagcaactcttaatgtggttttctagagcggtatcttccatttcccacagtttcattttcatagccaacctttgctactcccctatgctctaacccaccaccactcttctcccttccttcttaacagatcatgtgcagagaaaatagcatctgtgagacaggaaattttgagattcctactaacttaccagtgtccctaaatccttttattctccccttctattgatgcctcttcctctataaaccaattctttcatcagtgctctggatcctacagctatctgtgcatgttctaagggtgatagttcaaatgaatattttcattttgcatgttcaaccttgtccctttctcctgattccttcctcttggcattaaacatgtaaaaatatctttccccttaaaaccaaaaatgcatttgtgcataaatcttcaccttatttcaagtccattattagctacactgtaactattacctctactcatagctaaatgtctccaagatttttcaatattttgtgtcacattcattcacacctcaacacactgaggctttccttgtctggttgtctgaagctgcttcaagctcaccaaagttagttgtgtgacttatattgcatatagaatatacttctttgctcccttagcacaattttgtactattgatcattcattctatttcagaatattattttttgatgaaatctatattattgtacttctgtctttctcctcccttgatagcattgcccaatctcatttgtgtgcttatctttcttaaaatacatattctacaagattctttatggcaccctcattttctatcatacttagattctcactgaacaaattttatcaacttccatgtcttcaatttccattgacttgctgactccctcatctttacctcttctgatattcagtccctatactcacctgtcttctaggcagctctgcttgtatatcccatatgaaattcaaaaattattaaaatataccagcagatttgtgaataccactattttttctgttataaataattaaaatatatgtgatattgatatatataaacaacaaaatgaaaataataaaattaatgttcttaacaatgatgcagaccccagaaactttaatcttgagcaggcctttgattttatttagaacttctagattataaaccgtgaggcaaggtgtctcaagcacctaatgtgggctagggttgggagcatattatgtactcaaaaattatttgggaaataaataaaataaatagcttaatatttgaatgaatcttaaaggattttctttttccaagttgtgttaacaaattattttgctcatcctaatattgattacaataatagcaatggctaacatgtactgattaattacattgtgccagttcctctgattgtcatttcatatataatctttaccagaattctataagtagatataattcttattgctatgttataaacacgggaacaactggagttaactgggcaaattaacctcttcagtatcttcaaactgaatgtgtataggggttggacttgaatcaacattgtctaataccccattatatataatacagttatattatatatattataatatataacagttatatatattatatatagctaaatataattatatatatttatatatgaatttttagaaaaaataataccttctatattcctggttctttgatacagacattcatattctgatgtttttgctattagtaggcctcttcggattctcagtaggtgcacatgacttaggtgtcatcaattacgattatagtttggattgtcttgaaaaaataacttagaatatgcattcagaggctacagtaatcaaaacaggatggtactggtacaaagaccaacacatagaccaatggaacagaatagacaacccagaaataaggcacctcacctacaaccatctgatcttccacaaagctaacaaaaacaagcaatggggaaaggactctgtattcaataaatggtgctgggataactggctagctatattcagaagattaaaactgggccctttctttatactacataaaaatatcaactcaagatggatgaaagactttaatataagacccaaaactgtaaaaaccctggaagacaacctaggaaataccgtgctggacctagaaactggcaaagattttataacaaagatcccaaaaccactgcaacaaaaataaaaattgacaaatgggacctaattaaactaaagaacttctgcaaaccaaaggaaactatcaacagaacaaacagacaatctacagaatatgagaaaatatttgcaagctatgcatcgaacaaaggtcaaatatccagaatctttgaggaacttaagtgtatgaacaaaaaaacaacccattaaaaagtgggcaaacgacatgaactgacagttttcaaaagaagacatgtatgtgaccaacaagcatgtgaaaacatgctcaacatcactgatcatttgagaaatgcagatcaaaaccaccatgagataccatcttacagcagtcagaatggctattattaaaaagtcaaaaaatagcagatgctggaaggttgtggagaaaagggaacgcttatacattgctgatgagcatgtaaattagttcagccattgtggaaaacagtgtaatgatttcttaaagaacttgaaacagaattagcattcaacccagcaatcccatgtttgagtatatatccaaaagaatataaatcactctaccataaagacacatggacgtgtatattcattgcagcaccattcacaatagcagacatgaaatcaacctaaattcccatcaatggtagactgaataaataaaatatggaacatatacaccatgaaatactatacggacacaaaaaagatcatatccttagcaataacatggatggagctggatactactatagtaagtaaaataacacaggaacaggaaaccaaatactgcattctctcatttgtaagtgggagctaaacaagaacacatggacacaaagaggggaacaacaggcaccaaggcctgcttgagggtggagtcttggaggagggagaggatcagaaaaatacccattgggtactatgtttattcttgggtgatgaaataatctgtacaccagtcccctgtgacaagcaatttacctgtataacaaaactgcacatgcacccctgaacctaacacagaagttataataataataaaaaagaatgcttaagagtttatgtaagagtaagggagatagaatgcaagtagaaattatgaggaaatattggaatggccgagagatacagtgttttctccatagtagaggaagaaaatacagtaaatttggaaaagatggcagaaacaattgacacatggacaaacaactaacaaatatatcctgcagagccaattaaaaactgaaatataaaatccaggtcagatggtttttataattgaaaaaagactatggatggcaaataagatgaataaaaaaaggatattagaaatataataaggataaacataatttaaatacgttaaaatacatctataattttaaaaatatgaggagtggaataaccaggaattaaaatgacatatagaaaaaaatccatgtatcggttagtgggttttattaatttagattgctgtctttgtacatatctttcccagaaatgtgaagcaaaaaggaaaataaaatgttgattgctattctgctggagtagagctgaatggatgtgggaaatcagagaatttttgtactgattatggttttttgcaggaaggggagtcataccaatattttcttctcagtttgaacacagtttcatttcacagaaattaatagataagatactttgaactggagtacacctactgatttcttctgatgtcagtcagttgttagaatgtatttactatgcttttcaaaatcaaaagaaaatattataatcattcagccacataaacagtggaagattttccttggactaaacagatcttttgatcttgaagctttatacctttcccatttaagctatgaaaatatataatctttacagaaaatgtatggactgtttccttttagaattttatccttgtctcaaaaataaactataattagaaaagctgtctgttagtaactaattgcttctccctgctatcaaaccaattatagagactaattttaagaaaggaaactttatagttgaggcaaacttaggtaggtgataatccttcccccaacccttactctccaccttcccccagtccactatcatgtttcgcacagctaacttctggtggataatatggaaagaaaaattgttttcagaaattgctttaattagcaatgactggcatgaagtgataaatggaaatgaatattttagaaactcagagatatattatttaataattatattaaagtaataaggtcatttgaagtagcatttttatttttattttttattttaatttttaaattttttattttttgaaacagagtctccctctgtcacccaggctggagtgcagcggtgtgatctgggctcactgcaacctccgcctcccgggttcaagcaattctcctgcctcagcctcctgagtagctgggattacaggcgcctgccacagtgcttggctaatttttgtatttttgatagagactgggtttcactatgttcaccaggctggtctcaaactcctgacctcaggtgatcctcccacgtcggcctcccaaagtgctggaattacaggcatgagccactgtgcctggcctgaaatagcatttttagattagacatttaaaaacagaataaaatgtatgtattagttaatagctttattaattcaggttgctgcttttgtacatatctttgccagaaatgtgaagtgaaaaggaaaataaaatgttgattgctgttctgctggattaatagcaaattataatagaaccaattacattcgttatatactactactttattagttatgtacttttttggcttttgaataaaatcatactctaccttgcttacttttaacagggagagtattttcttcatgttgatttgattttggaatctgattttttttgttaaatctcaatcatggttgtttttatttttttttattatactttaagttctagggtacatgtgcacaacatgcaggtttgttacatatgtatacatgtgccatgttggtgtgctgcacccattaacttgtcatttacattaggtatatctcctaatgctatcccttccccctcccccgaccccacaacaggcccccatgtgtgatattccccttcctgtgtccaagtgttctcattgttcaattcctacctatgagtgagaacatgcggtgtttgtttttttgtccttgtgatagtttgctgagaatgatggtttccagcttcatccatgtccctacgaaggacatgaactcatcattttttatggctgcatagtattccatggtgtatatgtgccacattttcttaatccagcctatcattgatggacatttgggttggttccaagtctttgctattgtgaatagtgccacaataaacatacatgtgcatgtgtctttatagcagcatgtcaatcatgattttttaaaatttccaacttttatttttaaattcaggggtacatgtgcaggatgtacaggattgttacataggtaaatgtgttccattgtggtttgctgcacagatcatcccatcacctttgtattaagccgagcatccattagctattcttcctgatgcactccctcttcccacccccaccctcagatagtccctggtgtatcttgtttgcccccatgtgtctatgtgttctcatccttcagcttccacttataaatgagaacatgtgatatttggttttctgttctgcattagtttgctgaggatagtggcttccagctccatccatgttcctgcacaggacatgatctcattcctttttatggctgcataatattccatggtgtatatataccacattttctttatccagtctattgttgatagacatttagattgattccatgtcgttgctattgtgaatagttctgcaatgaacatgtgcctttatgtatctttataaaagaacagtttatattcctttgggtatatacccagtaatgagattgctggatcaaatggcatttctgcctctaggtctttgaggaattgccatactgccttccacaatggttgaactaatttatactctcaccaacagtatataagcgtccctttttctccacgacctcgtcagcatctgttgtttttttactttttaataatagccattcttattggtgtgagatgatatctcactgtgtttttgatttgcatttctctaatgatccgtgacgttgagctttttttcatgtttgttggccacatgtatgttttcttttgaaaagtgtctgctcatgtcctttgtgcactttttgatgccattgtttttggcttgtaaatttgcttaagttccttatagatgttaggtattaggcctttgtcagatggatagattacaaaaattttgtcccattctgtaggttatctgtttattttgttgataatttctttgctgtgcagaagctctttaatttaattagattccatttgtcaatttttgctttcgttgcaattgctttggcatctttgtcatgacatcttggcctgtgcctatgtcctgaatggtattgcctatgttttctcctaggggttttatagttttgggtatgtattcacatatttaatccatcttgagttgatttttgtatatggtataaggaaggggtccagtttcaattttctgcatatggctagccagttgtcccagcactatttattaaatagggaatgctttccccattgcttgtttttttcaggtttgtcaaagatcagatagttgtaggtgcgcagtcttatttctgggttctgcattctgttccattggtctatgtgtctgttcttgtacctgtaccatgctgttttggttactttagctgtatagtatagtttggcatcaggtagcatgaagcctcgagcttttttttttttttttgcttaggattgtcttggctatttgagctcttttttggttccatatgaattttaaaattcttttttctgattctgtgaggaatgtcaatggtagtttaatgaaaatagcattgaatctgtaaattgctttaggcaggatgaccattttcacgatattgattcttcctatccgtgagcatggaatgtttttccatttgttttgtgtcatctctgatttcttttagcagtgctttgtagttccccttgaagaggtcctttatttcccttgtcagttgtatttctaagtattttattctttttgtggcagttgtgaatggaagttcatttgtgatttggttgtatgcctgttgttggtgtataggaatgctagcgatttttgcacattgattttgtatcctgaaactttgctgaagttgcttatcagattaagaagcttttgggctgagatgatggagttttctagatttaggatcatgttacctgcaaacaaagatagtttgacttcccctcttcccattctaataccctttatttctttctcttgcctgtcaatcatgatttttttcaaattgtggtacactattaataggagacaacgcttttctaaagcagaaatcactacgcatctcagatacctcaagttgcatgtgattttaatttaaataatataaaaaagaataatgttctagggtccaagtatatgttttcaatatattaaaatttatttacatgagatgaatatacaatttattggtgtttttttcttttctgaagatttaattggatttgagggaaatacaggctgcaatggtgggaatagttaaaagtgagtagtcttttccactttaaataatcacttttaaatatggtcctgatggatttaaggttgtatttgtttaaacaaaagccacatatacaactagaaagagatagttcctgaattttggttaagagtccaggtttgaaaagttagccattttcttcaaaagaatgtggagttttaaaataatttcacatttgaggcaaattcttatctttccagagactgtaatactagagactagtaaaagttagaattttggaaacagattacttaaatcaggcttcgttttaatggggaattctgtcttccttttctttctcatttattctgttttgtgaataacccttgacagtcctttgggtctgttggtctatatttgcacggttttcatgactgtatgcgtgccatgtactcacgtacacatcggcacaaatatcagatgagtcagaaatttagtccgtatcactattattggtgattttcttattactttaaaataaaacatatatcttcctcattattcagataataaatactatttctagttactatataaaatcacaaaacgcattagagaagcacaatgaaaattcccacatttacacgtttttccaatgcttgtatatgaataagttaaaaaacagttgcaatcatagtgcattcataagtagacattgcaatttttaaaaatagtgtcataatatctcttaacttaaagtcttttctcaatatggggtatttaaaacagtgttcagtggagaaattactagttcaaagtatatgataatttttaagaaaatgggtcaaaaatcttatttttaataaacgctatttctttccaaaaatgtttttaccaatttatgtttctatctgcaaagaaagaaaggacccgtttatcccatctttgctaaaatataattttgttacaaatagtatttaattttgatttatagtcctttaatatgcacaattattaattaaattaattagaagttttgcagaatgataggggaaatgtcgctttgtttacaggttggcttttcatgtgcttgtacacataatggtaatctctgcttacctgttatatctcgcattatatttttccttttctcctatatttatggcagattttcttgttttttaacatctgtgttttctattaatggattatacactccattatattagttgctttatattgattgacaaattatcatctttagcaatattatatgacaagttttctttgctaataagaatatgaattttaagtccatgaggacttgaaacttttactttactgttaattaattggagagtattcaatatttggaatatttagttctttatgtaattatttacttctttcctctaattgcctgtcttttaaggcacttaacttatgattaacaactttaccaggaagtttgcaggaaaaaaaccgaagctccaagtcaaattattaaatatgtttatataagctttaatgagttgttttgttttttcccctgtggaagaagactatttcacctattaatactttattaactagtttaagaaaagagtgcatttattccatggataagatgttgttaaaaatcaatcattaaaatatgggagcagacaaataaaactttgtttacatttgtgcaagtttagtatacctctagagtaccctgtaaaagccccttcttcatctcccctttatgctactgggggttcttttgtgtctagggttctgtgcttttgtttgactttatttcactttctatcccccattaattgtcaaccagactagtcagagtgactctgatacaattttacaagataatatattattcctcattatttttctacaaataaatgcccctgttttgaaatggaagcctagataagaaataaccacattattctacacatttcaaagaaagaacacttgtaatatatttcttacatattttgtcatgaagaattcagaagccttaaggccaactaggaagctgcagtttagattttctaatggttggatgtctcagtggaaacatttattttctttttaatcaggagatttatggcagaagatggccagctagctgatagatgtctactgggaactgtctaaatgctctagtgttgttttaaatctctagttttatatctacttgaacattctgaatttctcccttcccctcttgaggactattaatgaacaagcttgaatcattggtttgccgtgttataagatgaacactgagcagtcattaaatgctatatcaaatgaactatgataaatttttaggttgatgaataggatttttaaaatcactaaatttcattatgtttttgaggcccatatattcctttttaaaagctttctttatgaggacttcttaatttcattatattttaataataatctattccttttaaagtcccaatatcatatattttaggttttgacaaccatagcatcttcatagaatgaatatccctaaattcaagcatggctgaagagagctatgggtaacaaattgccttgacacaggacatctgccttataaaatgttactgctttctaaacattctctgtaaatttatctccacccttatttcactcactctatggccaagtattgtttgtcacttcattctctcaacatttgtagttatgtataaaaactatctgttaggagttttacatattggaattactccatatgtttcatacatcattttcttatccctaatccactgcttttgtatatctcccctcctggatcctaagacaaaaggcaggaattgtgtcttgttgtctgttttgttttcttctcatatttctttttatttaattcaagagaaaagttgaaaatacctcacagtacctgcctatcagacaatgtgaggtcgagtgggccacagcactggcatcaccccaggttgttagacatgtgctatccccggccttatcccagccctactgtacagaaatctgcattttattttatttttctttccaacatttattttaggtttacgggggcaggtggaggttcgttacatgggtaaattacatgttgtggaggtttggtgtgcagattatttcgtcacccaggtaatgagaatagtacacaaaaggtagtttttcagtacttaacttcctcataccctccaccttcaagtaggccattgtgtctgttttttcttctttatgtctatgtgtactcaatgtttagcttacacttataagtgacaacatgctgtatttggtttttctgttcctgtgttaattcttttaggacaatggcctccagctccatccatgttgctgcaaaagacacggtttcattctttttatggctgtatagtattccatggtgtgtatttagcacattttctttatttagtctaccagtgatgggcatctaggttgattccatgtcattgctattgtgagtagtgctgcaatgaacatacacatatatatgtcttaataataaaatgatttatattcctttgggtatatacctactgatgaaatggctatgtcaaatggtagttcggttttaagctccttgagaaatcttcaaaacgttttccccattggcagaactaatttacagtcttattagcagtgtataaacattcccttttctccacaattttgccagcctctgttatttttgaattgttaatagccattctgactggtgtaaggtggtatctcattgtggttttgatttgcatttctctaattattagtgacgtttatcgtttttccttatgtttgttggtcacatgcatgccttcttttgagaagtgtctgttcatgtcttttgtccactttttaatggggtttgttttttgcttgtttatttaagttccttatagattctgaatattagacctctgatggatgcatagtttgcagatacgttcttcctttctgaggtgagggttgtctgtttgttgtctgcttggcagaggctctttaatttaattaagtcccacttgggaatttttgtttttgttgcaattgcttttggcatcttcatcatgaaatctttgctgggacctatgtccagagtggtatttcctaggttatctcctagagtttttatggttttaggttttgcatttaagtctatagtccatcttgagttgacttttacatatggtgaaaggaatttcaattttctgcctatgactagccagttatctcagcatcatttattgaataggaagtccgttcctcattgctagttttttttactttgttgaagatcagatggctgtaagtgtatggctttattcctgggttctttcttctgttccactggtctatgtctgtttttgtaccagtaagtaccatgctgtgttggttactgtagtcttgtggtatagtttgaagtcaggtagtgtgattcctctggctttgtttttcttgcttagtattgctttggctatctgggctcttatttggtgccatatgaactttagaatagtttttttctaattctgtgatgaatgtccttggtagtttgataggaatggtattgaatctgtaaatggctttgggcagtatagccattttatcagtattgattcttccttctcatgagcatagactgtttaaccatctatgttatctctgatttctttcagcaatgttttgtaattctcaatgtagagatatttcattgtcctgggtagctgtattgctgtattcctaagtgtgtgtgtgtgtgtgtgtgtgtgtgtgtgtgtgtgtctattgtgaatgggattgcctctttgatttagatctcagctctgacattattggtgcataaaaatgctactgatttttgtacattgattttgtatgctgaagctttgctgaaattgttcatctgatctagtagccttttagcagagactgtagggttttctagtataaaatcctattgtccacaaacagagatagttttatttactctctttctatttggatagcttttatttctctctctcgcttgattactctcactatgactcccagtatgttgctgaataggagtagtgagagtgggcttccttgtctttttctagatcttaaggagaacgtttccagcttttgcctattcagtatggtgtttgtcattggctgcggttttgtcataggtggctcttattttaagatatactcatttcatgcctagtttgttgaaggtttttaacatgatgccatgttgaattttattgaaaactttttctgtgtctatcaagatgatcatgtggtttttatttttagttctgtttatgtgctgaagcacatttattgattcacgtatgttgaaccaaccttgcatcctagggataaagcctacttgatcatggtggattagcttttcaatgtgctgctggattcagtttgctagtatgttgcttttacctctatgaggatttttacatctatggtcatcagggatattggcctgatattttctcttttctttgtgtttgtttttaggttttggtatgataatgatactggcctcacagaataagtgagggaggatttcttcctcctcaatttttgggaagagattcagtaagattggcaccagttctttatatgtctggtagaatttggctgttaatccctctcatccagggctttatttggttggtgggttttttattacttattcagttttggaactcacccgggaatttatccatttcttctgttttctagtctgtgttaatagaggtgtttataatagtctgaggttttttgtatttctgtggagtcagtgataatgtctcctttgtcacttatgattgtgtttaattttctccccctttttattattctaactagtggtttattaatcttatttattttttcaaagaaccaacttttggcttcattgatctcttctatggtttttcatatctaaatttaatttagtttagctctgtttctggttatttcttttcttctgcttgctttgagatcaatttgcccttgttttactcgttcctttaggagtgatgttatgttgttaatttgagatcttttaaactttttcatgtgtgctatagactttcttcttaatactgctttagctatgtcccagagattctggcatgttacttctttgtttttcttagtttcaaagaatttcttgatttctaccttaatttcattgtttgcccaaaagtcattcaggagcaggttaatttccatgtaattgtatgtttttgacagatcttctttttcttttttttctttttttctgtctttcttttttttttttttttttgagatggagtctcgctcttgttgcccagcctcgaatgcaatggtgcaatcttggctcgctgtaacctccgcctcctgggttcaagcgattctcctgccttagccttcccagtagctgggattacaggggcctgccaccacgcctggctaatttttgtatttttagtagagatggggtttcactatattggtcaggctggtctcaaactcctgacctcaggtggtcctcctgcgttgccttcccaaaatgctgggattacaggcatgagccactgtgcctggcccgacagatcttcttagttttgatttctatttttattgctctgtgttttgagagtatggttggtatgatttcagcttttttaaaaatttgtttataattgctttatgggtgaacatgtgattgattttagagtatttgccatgtacagatgaaaattatacatcttctgtttttaagggatgaagagttctgtatatgtctgttaggtacatttggtcaaatgttgagttcaggtcctgaatttctttgttagttttctgcctcaatgatctgtctaatactgttggttgggtgttgaagtcccccattactattgtgtggttatctaagtctctttgtaggttcctaaaaagagaatttctgtgccccagtgttggttgcaaatataatattcttcttttgtcttttttgatctttgttgctttaaagtctgttttgtctgaaattagaatagcaactcaatatttttttggctttctatttgcttggtagattattgtccatacctttactttgagcctatgggtatcattgcatgtgagatggttctcctgaagtcagcatatgcttgagtctttcttctttatccaaatcttcactttgtgccttttaagtggggtgtttatcctgttaagtggggatgtttagcctctttatgtttaaggttaatactgatatgtgtagatttgatcctgtcatcatgttgttagagtagcttgttatgtaaacttgatcatgtaggtgttttatagcgtcagtgggctatttatttaagtttgtttgtttgtttgtttttttggtggccagtaatggtctttcattttcatgtttagcactcccttaaagacctcttgtaaagtgggtctgtgataacaaattccattagcttgtctgaaaaggattttatttctccttctcttacgaagcttcatttggctggataggaaattcttagttggactttcttttctttaagaatactgaatataggccccacagtctcttttggcttataaggtttctactgaaaagtccattattaaccagatggggttccatttgtaggtcacctgcctctcctctctaggggcctttaacatttttctttcatgttgaccttggagaatctgatgactgcatgtcttggggatggtcatcttttacagtatctcagaggatttttctgaatgtatctttaatgccttagcacagtgttggcatttatgtgggcactaaattatatctgttggataaatgaaaggaatattttagctttataattaaggtggtaattttattcttaaagtaatacatgattgtagcaaaaattcaagcttgcagaagactgtaaattctgttgttcggagattaccaagtttagtgagtgtatctgtaaattttctgggaatgtgaaaatttacacagacagacacacatacatatttcctgcttttttgtgtgtgtgatgatctcaggtctgtgaaggttctggaatttgattttacctcacataaaagctaaaagttagcttgttattatgtcatggatttgggcagaatggacttctgtattagagcaaaggacattttttactcatggcacaggaagtacatgaaccatcaaatgtcacgtgtcaatgcagtttgtcacatattggtcttttaacacatgcttgcatatacggatatccattctatgaagatgctatgactataaaagtacaatatatgtttgtgtgtgttccacttgcttcctgtgtcctattgagggtatgtggatagccccagtggattcctacttacatggtgggttgcattacagaaaaagaccaataaccttagataagctactattttataataaacatttttcaatattccttactgcaaacacagttatgaaaagtggcctggctgtttggggccttgcattcttggcatccccagcaagaagtattaggagtttatgagagtggaggagtgtctctcaatgatatccacttttgatctttgatcatgttggcttctggtgaaatttcatgtgattatggcactccattgaacaccctaaataatatgacagtggctggggtcagatgtatttagtttttctcatacagcatttatataaggctattatgagcagaacttctaacaacaggattaggccaacttggagttttgactttactcatgtttccctgtggtccgggactcagtcactgtaaataagtctaagaggatatcaataggttttattctataaagccaaactgtggtagtctaagaacagtgtattatccagcacaactgacacaagggagtttacatagaactgcttatctttggttatcattgcaatagatgatttaatagaatctgaatttccatggagagatagtccatggctcactcagcccatatacaaacatatagcccaaagggacataaatctgtccaatcaggattttttatttaactttatttggatcatcattacattggtctgattaagcatgtgtcatgtcactgaagagttgtagcctggattgtttacatggcataagccaaagtgctcagatatcaggagaagcaagtgaatttctatcagccagatagaaacaatgttatgcaagttcctgtgtttgtttaggtgggaggaagggtatctttttgggagcagccatttatggcatcaggcacagcagagcagttcaggactggccatgcccacatgagtttttctgtttcatagcacttggaagagatgacaaatggaacagcaggctggattgtcagccacagatgctacttcactcaggcaggccatatgattattttgccaggctctgattctggatctaggtgacaaacagagcattaattaacccatcctcttccccacaactcttggtgtacaagccatttcttccccagatgtcagttattgctttctccacagccatgaaattttgtgtgccctatttcagtataactttgctttacttctctccagtcctctattaatctaacccagagctttgatatgaaagtattaaatgcaagtggaacagagacatttttacaaaatatacagagactcattatacctcccatgtttgcccacataggccattgtagagggattcagttagcagtagagttagctgtctgtgtctgcagtttctgcattcgcagattcaagtaaccttggattgaaaatatttgtgaaagaacacaataaaaatagaaatacaacaataaaatcacagataaaaacaatttagcattaacaactatttgcataacactcacattgtattaggtgttatgaataatctagaaatgacttaaggactacaggaatatgtgcataggttatatacaaatactatgccattttatataatggacttgagctttgagtttggaaaatctaataccttgactatcattttattattaggtggcctttgcaacaaatggcacaacattgccagactgtagatggtctggaaaccagcaaatatgacccagtttagtttcatgggccacagtggtatggctggaggtgactgattggcctgaaacagcagccctgtagcctgaaaccaggtaggatggtgatgtaggcacctttatcacagagagccataaatattcttattcccgccatcccttcttagcgatgaaccatacttgtgtttcaggccaaggataggatttacaatttattttaaatgtgatagaagctgttgatcaataatgagcagaacagggaagatatctaattaaatttaattttttttttttttgagacagtctcactctgtcacccaggctggagtgcagtggcatgatcttggctcactgccatctccacctcccgggttcaagtgattctcctgcctcagcctcctgagtagctgggactacaggcgtgtgccaccatgcccggctagttttttgtatttgtagagacggggtttcactgtgttagccaggatggtctcaatctcctgaccttgtgttccgcccaccttggcctcccaaagtgctgggattacaggcgtgagcaaccgtgcctggccattaaatttaaattttaacaggaaccacctgccttttgtgagaagactagattataatgggggtgcatttaagatgctaagacatagcatatgatcaagcaattctacacctaggtatatacccacgaacaatgaaaacatatgtctacagaaaatttgtacctaaatgttaacagcttaaatttttcataatagtcaaaaggtagaaacaacacaaatgtgcatcaagtgatgaatggataaataaaatgtgtatagctatacaatggaatattatttggcaataaaaagaaatgaagtacttgtatatgctacaatgtgaatgaacattgaaaacattgtgctaaatgagagaagacagtcatgaaggcaacatattgtatgattcaatttgtatgaaacattcaaaataggaaaattcatagccaataaatcagattagtagttacttatgtctatggatgatggtaggattgagggttctagcaaaggggagtggtttactttttgaggaaaggaaatgccctaaaattgattgtggtgatagacacacaatgtgtgactatattgcattgtatactttaaatgagtgaattatcagatatatgaattatatctcaataaaacttttttaaaacaatctaaggcagcatttcaaaatcctggtggctgcttggtctatagttgtagtggtggaattggtgaaaagtggcacagaatttgctgcacaatcaaatatggaatgtgaaagaaacaagttgctagaaaggagtacacggtttatggccaacctataccaaatgctgctgagtatttatgtaagatgatgattaagaattgatcattggatttgaccgtgaccttatcacatgaggtttccacgtagtggcaggacctaaagcctgtgaagtttaagagagaatgggaagatagggatgtatagacatatgtaattattgtcaaaagttttacattaagggtgagtagatggatgtagggatacctgaagagaggtgtatggtgaaattactttattcaaagattattattaatataacatctttgcatattggtaataatgacttgttagagaagataaactaatgcagaagagaaaagtgcattagtcaaatccttgaatatgtgagggtagagggtattgcattctttaaagggacagttcaccagggtaacagttggacttgtagaatttggtatggtagtaatggaaacaagcaagcaatacatttaacatggcagtatgcaaaattctcttctgattgtttatatgttctctgttaaatgtagatgcatagtgatcagccatgagaaaaagaaagtgtggagatgacagtatgaggaagtcaaataagctgcaaaattgttgtctgaaagatggagattgatttggactccactgcagtgtgggctcatagatttaaaatgagaagtggtggaataatttgggagtttcatgacagccatgttcacctgtttgcatgtagaagtggagtataggaaagtgaatttaactagccagtgttttagtttgctggggctgccctaatgaataccacagactgggtgccttaaacaacagaaatatattttctctcacatttctggaggctagaagtccaaaatcaagatgtcagcagtgttgattttattctgagtcctctttttgtggttggtaaatggacgccttctctctgtgtcttcacatggttttcctgtgtcctaatctccttgaagggtaccagtcatattagattagggtccacccatcacacttcattttgtctaattacctttttaaatcccctatttccaaatatggttccattctaagatactaggggttaggacttgcacccatggatttttggaatgtggcaggcaagggcaattcagcccataacaacaaatgctggagttttaaaatttaaatatattggagtgagagagggcgtatgtaagagaagcgtaatcctgttctcatatagcttaccatttaagaaagggggacaaataagaaacaaaaaaaaccccacaatttttcaataaattgggggtgataattgctaagaaggaaaattaagtggggtgagaagacagtgagtaaggtgtgtgtgctgttttatataggctgataggaaagctcgtggtgatgtgacatttgagcaggaaggaaggaagatctgaaggaaacaagagcagggagccatgaacctatgactgggcagagaaagcacaatcgcacatgccctgaggcaagctagtaattcgtatatttaaggaacagccaggagacctaagtcactgatgtgaacatggtaggaaatgagatcagaaaggcatgaagtagaagctctcttatctggtgaacttgtgactacaatttatttaatcaaaagttgatgatatcagggaatcatatgatacctatttacctttaaaagggaggtacaatttacattgagtgaaatgcactgatcttaagtgcatagttcaatgagttttcactattgtaaaaccttgtgtgactcataccacattagaaactacatctaaaatagttctgctttgtggtacttttgttatccaatcccctgaacacctatacactgagcatgcaatgtttctgcaagggtgggtagggagaatcctcattgttttttcttgctcttagaatgatgtttctgatgataacaatatgtgttactactagtaataataactaatctatattgagttcttatgtgccaggcactgttataagaggttacgtgttacatccctgtactcatcctagccttacaaggtaactactattcgcattttgtgagtaggaaaaccaaggcattaaacatttaaggaacttgaatcaagttgcacaattagtgagtgttgaaacccagactcaaatcatgacaatgtaactctgaaacgttttcttttacaggctatgttaggttccctcctgagaattgaattttagcgtatcatcaatattctccctttccttagtgtatatgcaaatgagggcattttttgttgttgtttttttcagttttgtttattgcttctcttctaccatctttcagtaaaaggcatttatttagcattatatttgttggcttctttgtctcttagtttaacctttagtgtgatgtggttattacagtggacactttggtttaggctgtgagtggatttcctgggtttaacttaagtttttgtctttttttttttttttttgacagagtcttgctctgttgcccaggctggggtgcaatggtacaatctcagctcactgcaacctccgccccccaggttcaagtgattttcctgcctctgcctcctgagtagttgggattacaggagtccgccaccacgcccagctaattttacatttttaatagagaccgggttttgccatgttgaccaggctggtttcgaactccttacttcaggtgatctacctgcctcagcctcccaaattgctgggattacaggtgtgagccaccgtgcccggccaatttcttatctttattcatacaaagatctgttttcctatcagttagacctgaagctaatttatggtattttttcagggcttactcactacgtttatcagcccataaaccaaactgcaaaattatttggtcattagttcacagaagctcctgcctaactatttaaaacatttaaagtatgctgagtgcctgaaacttctggaagcattaccagcagccttacactagtttccaggatcccttggcagcctcaaggatagcctcagaaaatagactgaaaacatttgctcccattacacaattttctacaaaagaaagtttatgactatagataaaaatatgtctaatagcaagtaaaatagattccctaagtaataacttcctaattaaaaaagaacaacaaataaaaaaccaaagcaaaaacaaaagcttttttcttcttaatttaacaacatagttacaaaaccctaaactttatctagattttatttcttatatttaacatcaaaattttttttgagatggagtttctctcttgttgcccatgctggagtacagtggcactatctccgttccattacaggcacacgccaccttgcctggctaatttttgtatttttagtagttacaaggtttcagtatgttggccaggctggtcttgaacttctgacctcagatgatccgcccgcctcagcctcccagagttctgggattacaggcatgagccactgtgcctagccttaaaatcaatttttaataaagataggaaatatggtacacattttcaagtaaaaatcctataacatagacaatcttgctgataccattacttaatgtttttgaaacaattaggaaaagggtaatagtattggatagaaaagtctgtagttcatgcaagttgctcatgcactacactggtttggcaagccagggatattgaagaacttggattttctgactgagaaacagaacagtatttgcaaataagtaggggtttcctggaatagaaacataatacagatgctgattctcttaaataaacctgggccaccaactgtgcttacgttggttagtattctgtgtttaaagtaccatttttctgctcagttttcttcttttaagaggaatattgaaatacaatatataagattattattttataagtgccaggggattagatttctgtgaatgataaagtttagcctgttttcaaggtgtaggtgttttcaaaatataggtaaatttccaaattaaaaaatacaagcagagtctgtttcataattacataagaagtttaaacagcaacttagtttttcacatgatatagttagaattctttcagtgctaatgtcttaatatatagcactagcaggctatgaaattaggataatttgaatactgcttgaagtggcaataatatgtaattttgactttttatcataaataaagtttaagttaaattctcaataacctcaactgttaggcttttattaggaaatgacttatcttagacatttcaatatttaattaatactgagtgatttcagattttctattataataatattcttcatcttttcttgaacgattttttaaattctttatcttgattaagcctcacaatattttgtgagattgatggggcaggaaatatgttataaacaaatgaagcactgagaagcaagatacctacctaaggtcatccctttatttgatgacagagccagggatggtgctgtttacatcttccaggatcatttatgtatatggcactccttataaacttgggaatggccgtgtagtgaccgtcaatgttataggtacttctccatggaattattttctacaataaagtgaaaggatctaccctatcttaagactgaagacagaacatttgatagcttgaattgtttcatatctcaaatttagaaaagaatgtacacggtaacaggaaataaatatgggataatcattcctttattatcaggtttagaggctgatttccaatatttagctatcatttttatagaaaattaaagtggaaatgaaacaaagtagataataacatgttacttttttctaagaaaaaaaaccccaaatgtcatgtattctttggatttacatatatctctccattatatatatatatacacattctgaataaatgtaaatgtaatttttttgtaattactaaaataaaatctgttacaataattattttgtaactggcgctttatgtgaattttgaatttgttgctagtttaggttggttataacaggcaacagaatttctgttgctttatggtgctgtcagctgctgttaatttaaagagcttgtgctcatcaaattatactttgatgtttttgagacaaacgtttatgaaatatttcaagtgtctttgtatttaatactgttcaccccaattagctctgtcaaaacttcatcacttatcttattcacatcaataagcttacattttactcgatattatttaaaatgtaacaaatgatatcagaatatgttttgtctgatttacttactttatagataaaagttggttaaccaggtagttaaacaaatgtagtagtataaataaaatgctcaatgtagtataaataaaacaaataagtgtaaggtattcattctacacttaccttgaaaaatgtctcttaataattatgtacatatctttgttatagcctttaaattcttgctctgattattttaaatcatttatgttaatatatttttcccctgataaattggatgcgtgctatctattctaaacacacatttattgtagatactttctctgcagatcagctgggattttagaggctgtgtaattattgatcgtgtcttgcaattgctctacttaagaatatgagaacaattttttctgttttatgtatttattttattttatttttacgtatgtatgtattttttttttttgagacagagttttgctcttgtcacccagactggagtgcaattgtgtgatctcagcttactgcaacctccacctaccaggttcaagtgattctcctgcctcagcctcctgagtagctgggattacaggcacgtgccaccatgcctggctaatttttgtatttttagtagagacgtggttttaccatgttggccagactggtctcaaactcctgacctcaggtgatccgcctgcctcgatctctcaaagtgttgggattacaggcgtgagccgccgtgcccagctctgttttatgttttattaattatctgttctgcaagatgctttataaatatgattctacataatcctcataacaaatgaggtttagctttggcatttctatccacattatacagatgagaaaactgtggcttagaaagtcttctattcttaggaggtgtacagacccagacgtgtctgtctatgaaggccagattttagccactataatatattgtatcccaggatgatttctatttcagaattattggctagtcagaagtactgaattagagtaaagtcagaattgcactatttgacaacctggagctataaagaatatcatgatatgactttaagttcattacaatacaacttaaaggaatcaagtagtttgtcaagggcctggcagagtagtggcagatctagtattaggtattaaaatgttagccaactagcttgctagcaactttcatttatttaggcttttaattttggattcgaaggcttgagtactgatatatttgagaacattaaataagtcatacatttcatgttatatgttctttatccaaaaatctatgtgtacaattaatgaaattttcttctttgttttaatgcagtggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgaggggtaagtgcttatgaagcaaatactgtctttatagagatgagaaaagtggtgccttgacaaaatgagaaacttcagaatcagaagagttttgccttagtgagttagaagagcattttggcagcactattaatgcatgtttaaccatggggaagttactttacctttcttggtcttaggcgtcttcttggaagaaataagaagagttagctaacctctaagataccgttcaacctaataaattctggtgttctgtgactgtatgaaaagaacagttgagtgaacgttcaaactgggcagaattttaaatctaggctgctagaagccaaaagcctttaaagaccaagcacataacataaaacggaaaaaccactaaagtgagacaggtggcgattttagcaaacgaactgtgcatgaatgacaccgctaaagacttccaaaacagttgaaataaaacaaccaatttttaaaacaaaacacatggcggtatgcagatttaccagattgctggctgtatgttaagtgaaaaagataatttcaagtatactgtaaaattactttatttcagtattttcctcttgagggaccagtttcaaagactaaatatgaatgtaaacataataatttgtatgaatggttatttatcaagtaaagccatagagatttgttttctgtgaagttattccagttttctctatgctttcttttttgttaacttcaagatctataaatatatttctaatgtattcctagaaaattcaatacttctaaaatatgtaagagtactcaaaattagttttattctcattgaactaacatattctctgtttggcaaaagttttctgcataaatatgacaaaaagcaagcttcaattgaagtatcatgacatgtttgtaccttttggaaaagtgaatctaaattatcaagttgagatttacatttatttaatgaatatgatctgcttttaatgttatacatatttttgagatatttattgaacaaaatatttaataaacagaatctcattaacactatcaggttacatgaaatttagggaaacagaagagcatttccaaaatttaatttttgttcaaagagtactttagacatgttgagtttgctttagattgcaaatcaaagattactttagacatgttgagtttgctttagattacagaaatactcttgttcatttagagaaattctgaatcttctgaatcgcttccttgtcttttaaaatggaacttgcattttagattttgactaatacaaataatttaaaaaaatttgcaagtgactgatgctagacccatttaggtagtttacatgcattttttatgcctttatacttcagttattctgagaggggaacattataagtccatgtttttgacaaatgaacatggggaatgatttgctgatctttagttaaaaccccagaattaatcagccttctgagcttctttgtcagaatcagttgagttgctgcttggctgaatgtagaaaagtgtttttgatggattacatcagtttggaatgatcactctgtcatttgttgaaggaaaccatctaggttggtcacatacaaaaaatgtaataatctgattcagcaaaactttgatagccttttctgccagtaacacaaaggtacagttttgctgatttatgtccttaatgctccttaagtcttaaatctcaaaatgtgaaatttaacaatgcaaggcaaaaataacttttccttgtacttaaattgtaaaattaaactattgttctctttgttgataagacttgttattttacttcattcaggttgttaaaaaaatatagacttggtggctaacaaggaacagacatttatttcttacaattttggaggctggggattccaagatgaaggtgctagcagatgcaacgtctgataaggggctgttccttgtaaacagctgtcttctcactaacctcactaggcagaatagttgagaaatctctctggggcatattttataagggcactaattgcattcatgaaggttccaccttcatgacttaatcaccccccaaaggccctatctcctaatatcactttgaaggttaggatttcagtatatgaattttgcagagacacaaacattcagtacattgtactactttaaagttttatattaatactatttgtctggaataaatggaaaatagacttgagggttttaatttcattttcagttgtcacttgttatttcagaatttttactttaggagtttgcaccttgttttcaaaatattttatttgtaagcagatgatgctgtgcaaagtgtacctaactgaaattttcacattttaggtctgctaaaaacaggcttttttacttaaaaaaagatccttctggacctgtgcatctccattattaaagcaaaggttttggagtaggcagtttctaagttcccttatatgtctaaattttaaacaattcctaaggacccaatattaacatacactgttaatgaatttttgacatattttcattcattcactcattcattatttattaagttcttactctatgcaaatcctggggatataactgaggtccctgatgtttgggacataagggaacaaggctcccacctgccatggagcttaaagtcaaatatatagtaaacatttttgtctttctgtatgtatttatgtgactgtgtgtgtgtgtgcgtgtaatcatgtgccatataatgattttttgctcaacaactgactgcatatatgatggtgatcccataatattttaaagtaatgatcactgatgttgagttttttttttttcatatgattgttggctgcacatatgccttcttttgaggagtgtctgttcatgtcttttgcccactttttggtggtttttttttcttgtaaatttgttttaagtcccttatagatgcaggatattagacctttgtcagatgcatagattgcaaaaattttctcccattctgtaggttgtctgtttactctgttgttagtttcttttgctgtgcagaagcttttttgtttaattagatcccatttgtcaatttttgcttttgttgaaattgcttttggtgtcttcatcatgaaatctttttctgtgcccatgtcctggatggtattgcctaggttgtcttccagggttattatagttttgggttttacattcaagtctttaatccatcttgagttaattttccatatagtataaggaaggggtccagtttcaattttctgcatatgcctagccagttctcctagcaccatttattgaatagggaatcctttccccattgcttattttggtcaggtttgtcaaagatcagatagttgtaggtgtgtgaacttatttctgggttctgtattctgttccattggtctatatgtctgtttttgtaccagtgccatgctgttttggttactgtagccctgtagtatagtttggtgtcaagtagaatgatgcctctagctttgttctttttgcttaggattgctttgacttttgggctttttttggtttcatatgagttttaaaatagtcttttctatttctgtgaagaatgttaatggcaatttaatgggactaaaaaaaaaaaagctcaacatgactgattattagctaattgcaaatcaaagccgcaatgagattccatctcacgccaatcagaatggctattactaaaaagtcaaaaaataacatatgctggcaaggttgtggagaaaaaggaacacttctttcctgttggtgggagtgtaaattagttcaactattgtggaagacaatgtggtgattgattcatcagagacctaaagacagaaatactattcaacccagcaatcccattattgtatataccctaaggaacataaattgttctattataaagagacatccatgcatatgttcattgcaacactattcacattagcaaagacatggagtcaacctaaatgcccatcaatcataggctggataaagaaaatatggtacatatacactatggaatactatgcgccataaaaaagaatgagatcatgtcctttgcagggacgtggatggagctggaggcagttagccttagcaaactaatgcaggaacagaaaaccaaatagctcatgttctcacttataagtgggagctaaacagtgaggacacatggacacgtagacaggaacaaaacactctaaggtggagggcaggagaagagagaagatcaggaaaaataattaatgagtactaggcctaatacctcggtgatgaataagtgtgtacaacaaacccaagtgacacatgtttactgatggaacaaacctgcacatgtgcccctgaacttaaaataaaagttaaacaaattataacattttactgtaccttttctatgtttggatctgtttagatacacaaatacaattgtgttataatttcctatagtattgagcatagtaacatgttatacaagtttgtagcctaggagcaataggctataccatacagcctaagtgtgcagtaggctatactatttagtcttgtgtaagtacattctatgatgtttgcacaatgatgacatcgcctagtgatgcacttctcagaacacttccccatccttatgcaacgaatgactgaatatatattcaactgaaaaggaaaagtaagttagaaatgattataaaacataattgatattaggatcaggaagaagaggacactggatctagagtattagataaaatttctcaagccaggcatggtggtgtgtgcctgtaatcccaggtactcagaaaactgaggtgggaggattgcttgagttcaggagtttgagtccaggctgggcaatatagtgagacttcatctcaaaaaagaaaaaaaaaaaccttcacaaaggctgtaacattaaaattgaggtttacagcataagagtaggaaataactagtaaaaagcaaaaaaatactaaaattctaatagaatgataaagattccagaaagcccaggatacttgtaaaggagaaaaatacagagtggggatgtggcaagtaacagctcttaaaatttagtgtaattaaggctatataattggaacagagaagcacagggggagacaaattgtccaaaggaagagaattagccctctgatggcgaaccacatgtgtacatatgtttggaacattctttatatgacaggagaggcactgcagatcagtggggaaaagagaggctgttcaataaatggaaccgagaataaagtggcaatccatgtggaaagagatgaaattggatgcctaactcatgtcatgaagtttggatttaggacttaaatgtcaaaaacaaaatttaaactttagcagaaaaatatttagacatctataagaccttggaataaaaaaattcttaaaacataaaaaaattactgcaaaaaaattgataaatttgactatgttaaacttgagaaagttagttcattcaaatgtaccttaaagaagataaaaagagaagttaaaaatcgtagaatatatataaagcaaacgcaactgaccaattattaagtacgtataagtaacttgattgttatatatatcaagtatatataaaattttttctataattaataaaaaagcccaaataacccaatagaaaaaaatgggcaacagaactgaagtgacacttcatagaaaatgaaacacatatagcaaataaatttgtgaagaaataattaacatgaactttacttggaaaaatgcagatcaaggctacagtgatatatcacttatatttagtcagttggcaaaaactataaatggctgataataccaattgctaaaggtgatgtgtctctacatttttataataacttcagataacagttggacattatctctgaaatctgaacattcatatataactcagcacttatagtcatatacccaagaaaatttttcacataaacaaaatatccatagcactataattcataaaaataaagcctgaaaataatccatagatctattaatggaaaagttgattaataaatgttggtatatcaatacaaggagatcttatatagtagtttaatagttactatgaatgcacttcagagacttccatcaacatgattgaatcttgaacatataatagtaaattatgtacaaaaactacctattgagtactatgttcacagcctgtgtgacacgataatttgtaccccaaacctgagcatcgcacaatatatccatgtaacaaacttgcacatgtaccccgaatctaaaataaaattataagaaagaaaaaagttgtatccttcaaagattatatacagtataatactgcttaaaacactaaaagtaactaaaatttaaaaaatgtagtatttaaaaatatagaaaaatacaacaaaactttacaaaagccaaaaaagactaattatgaatatgggaattaggatgttgtctgtcatgtgtacgggaaattggggtgtgagatgggggtgaaaattttgactgactgtagggtattattacagtcctagatttgatttggatatgggtttgatgtgtctttttctctatgtggataactaaataagtgaataagatacactgaatggattttaaaagtgggaagccactgaatggacttaaaaatcaaagcaaacaggataagagttgtgtcacagaaagattgctgtggatacaatgtagagaatggattagagaagagctattctttccaggaggtctgggtaggagtctgtggcagtattccatgtattctgtgtaggaaatgatgtctgcttagagcaaaatagtgcaaaatgaggtgtaagaggagtaggtaaaaccaagaggcatttaagatatgatattaagagagctggattgcttgcttgattctggcaggtgtaggagaggggagtgtcaaggtcaagtctctggatttttgcagaagtttgtttgatccaatttcctgagagaaggaaggatgtaggagatgatttgagggtggactttgagtttgttttggacacgttgagtttgatatgcctgttagggctctgaaaggaactgttcagtaggaagttggctatatccttaaactctaaatatcaaacttgaaaaaacagtcactttaatggacatttttctaaaatggattacattctgaccttttattaaagtgaagtttatggactgtaatggaatctttgttacagagtcagtattatcattttacacatcaattattgaatgatgttgtaaaaaagaaatgatttcagtgactttatgggagcatgtagttctattccaatattagatacagacccatgaatgctatttgtttttctgttttttaaaggactgctcttgggcaacataagtacttgttaggggatgatattaaccctttcgtgccactctgatgccacctggaattaaagtgcactaaagatatttctgactcctaaatggtatggaatactaagtgctgctactcctaatttggcagagttagaataggtatttgagagaataggtatttaaaaagcccaatgatgccacagtgcacctgcaaacactttgtggaaatttgagggcatgtggtaggtttgcatgggcgttatgacatagtggatccttgtcctggctcccccactcatattctcaggcaagtagattaatctctctgggcctcagttgtaatatgtaatatgaaatgaatatgaatcatgatttttaaaatcatgccagtctgaagtgaatgattatatgtttctagctttaagaaaataagcctatagtaaaccagctattttattatctagcctttggttagtctacagataatatttggtttgagatgagaaatggtcatgcagagaagacacaatgggaaaggatctgcttagaaactccggaggtttcttatcatcacagagggcaaaagggatatgatgttatgatatgtattactcacagagttatctagagggacagaactaataggatagatgtatatataaaggggagtttattaaggagtattgactgacacaatcacaagatgaagtcccacaataggctatctgcaagctgaggagcaagaaagccagtccgagtcccaaaacctcaaaaggaaagctgacagtgcagccttcaatctgtggttgaagttacaacagcccctggcaaaccactggtgtaagtccaaaagtccaaaagctgaagaacttggagttcaatgttcgagggcagggagcatccatcacggaagaaagatgaaggccagaagacttagccagtatagtccttccacgttcctctgcctgcttttatcctaaccatgctggcagcggattagatggtgcccactcagattgagggtgggtctgcgtctctcagtccactgactcaaatgttagtctcttttggcaacacacacacacatacacccaggatcaataccttgcttccttcaatccaatcaagttgacactcaatattaactgtcacatgatattctagaagggaaggaaacctacctttctttgtcttattctgaaccttaaacatatgacatatgcataggaaatgaaatgaaagttacttgaaaaaagggaaatagcaaagcaagaatttctgattctatagaaaaaagatacatacattagtcaatagtaataacacaataataattttaagtattaactattctaaattatttacaagtgctacaactaacactacaagtgttagtaaattctcacaaaaaaatctgtaaagttggcattattattattattattttacatgtgaggaactgagacaaagagagggtaaagagatctgccagaacttttacaaccaatggaatgagctttggttattatagtgtaagttcacaaaatgattctgtcatcagtaaataccggtttgcattggaattcaagtactgtgttttcatttggataccagtgtggagatacacattctgaaaactccgtgttttgtctttactctcagagacattctacaccctccaggtctccctagcctgtaggatgtgtaaatctcagccaggaaaatatttactagtgatctttctgcttgcagataattagtaagacagttatcaccttctctggcattttaagttgctcttattcacttttgtccctcagacctccccaatgctgctctgaattgggggaaatcaaaatgagtggaattgctgaccaatgacttcagttcaaaacatttacatttttcttggtgctgccagggaggctaaggtttcttctcataaatccagggagacagatggccttgctctcttacatgtttggcaaaaggctgttgtgtcagccttttctatttttgttttttaaaattatctcctccttatagccatgcactcatttattaaacagcaaatgtttgttgattttgtctgattaatctttggtgctttggggaagaattcctatgtttacataagggagaactaaagaattaaagcaataaattaaattaaagcaataaaactaacagcaaatttttaaaatatatggcttcatcttttgcaagataggtagagggtatgattgattaaaatgcattgtcagtattggaattgcccttaataagttataatgaccactggaatgttgagattataatatttataattgtaaaacagtggaatataccaacacaattgatttggattaagggcatatatgtcccggataattttcaatcagttctatatacagtttcccaaaattaataggccttataaaattttgaccgctgatatttgctttgctctttcatactcttatccacaattcactctgacccttctgctcttctacatgggcatagtaatgtcaggaataacaattaattataatcaagatcacaatttatttattttaataaataattatagttactataataataatttattataataaataaataatgaaaaattattaggtttactgtgctaggtgctttacaagcaatattttgagtaactttaaaagcatcattaaaaggaggtactattattatacccatttacaaatgagaaactgggctatggaaagattatttaaattccccaaggttacaaacctctgcaaggactcacagctggtttgtcagacttttgagcccatatgttgaaacggtagactgtgttgtgcccctgacccaggcatgcctagactcctttttgccaaagtaatcataacatttatatactatgtatgaactatttatacaaacacgagtatttctggaggatgtagaaagaggtggccactgacttcgggtaaaaaaaaaaaagtcttatttaatagaaaagtgaaaagtacctttgccaggctcacctagccttattttagactagcaattttgcatttattgagtctctagagcacactgattaatttagattgcagtttttctcagcagtgagttttggggtcaacctaacaagtcttagaaaaaatagttaaaaattgaaagcaatagtgaaacaccagtttttccccaaagcttaataaaaatatttgataccattcattcattcagtagaggtactggagatttgatgtgctcataaataataaattacaaaacagaaagtggtacctgctgtaagagaagcaccaaataaacttgaataagagttaagaggccttgaaatatgggagttttatggacatgtgaaaattggaagggaagagatagcagaagaaagtgaagtaccaggagaagcatcttgcctttcccaaaatatggatatgagaaatcagtgaattagttgataggagcagaatcagtcataaaagggtttctagattttaagttgaacatcaggagaaagattttaaagggctgagtgctggggaaaggaattttaaccttgttctttacgaaaagggatcactgatggtttctctaaaaaaagtgtggatttgatgcaggactggcaagccccagagtggatcttagcctgtaaaggttctcagttttgcccaggaaagaattcaagggcaagccagaggtggaagaaaacagttttattgaacagtgttacagctctggtggggttacagctctgtgactggcaaggagtgcttgccaacctccactctcatctggccgagaacatccagctgactacaattcccctgacttgaagtcctctggctctgggggccctaccaagggacacgatggacccaaagcaggcagcacactaccgtagcattggtacaggacaaaataagagcttggccattgacactgccttcagcacaccctggcaaaaaaggtgggctacaaaacaaaacccaaaatccataggccaaagggaatggagttgggcaagcacctgccagcctcaaaacccttctaagcaaaaaccaaaagccaaaatgaggttacacattgaggaacaccaatagcatagaactaagttatgttgggagaaaacactgttcccacagacctctaagacaaaatactttagcattaggcacaacagcagtcataatcagaggagaaaaactcaaaggagctgacaaaaaaactaatggagagagctacatgaatctcagaagctttcaaaagaagtagatcacaggattgaaaataaaaatttctggtaatttagcaaatcaataccttaagaaaatttggttcagatatagagaccattttctaaaaagcctgttatagacagtttccttttaatacttccatacattctcctttactaacttttcaagacttatgcagatcatctataacatgctagaatgttctgacttgtcctatgctgcctatttcttaaataaccagtcattttactctagggcaagaatttactatacgagatcccttctcttataaaattactctttctttatatcattccttgcaaaataataataaatcttctattcatgatgttctctacatctctcttttttactcactggttccctcatattttgaacctcccttttaataactaccaaattagacaaaattatttttcccaataaagaatacatttctttggcacattttatgtaaacctagggaggaagaaatcctagcccaccagacactggcattctatagataagaatcattctatcactttaagacgttaaaccacataatacgctcactatttaagcatctattccattctttcacttttaacagttttatgtagactatctccgagaaccaagttgctatgcaaatctagtcaccatttaaagccattttaaccattttaaagcctatatcagtgatttaccaaagtaaaaatcttaatgtcaaatttcagaagatgtaacattatcttcaaactaatcaactttgactagtcatttaatttatgaagattatttataaaccaatttgatagcatgctagacaaaacatatatcacaatacttgtatatatgcctaaacaaacacattaaataaagttacctacacaagacaactggattcaagttatttacaaaattgggaccatctacttggccaaattttgtttgcctcaataggtttgaaaacaggaagaggcagggaaagggatccaatagcatcaaattagaaagggaggtagcaaacagcattgctcaaggggagaccctggagaccccgaactaccaaagagcgcaaccagcagtggagtcactgaagaaaaatgttcaggcagctgcttgtctgccactgtgggaagccatctgcagggacaatggtccaagacttccagtaaacttacttgagtaagacagtttgtgggggctagtagaagaaggttagctctagaattgatggagagccttttttctctctcttaccagggacagttaggacatgcttattgccaagggccctcttgcttaaagcaggtgcactgattctggcccaggggcaggcaagttgggggctcttgtctaggcatcccatcccagatgccaatttcataacattttctcatgatagataactcttagggggcaggggacttaggcaactgctaacaattgtactttttggctatttctttttcttttttttcctattgccctgagatagttctctaactgtgtcgtaattgactggcttacccatatactttttcctttgcttttttcccacagcagagcaagtagattatttgtaagtcatgatgagttaaatcaaagaacatggtcaacttaacaaactcctctatacactttactggattttctgaaaactttctatgtttttccttgtgtaaagccaaattagacatagaaaatggcacatgtactctaagtattccctcacttccgttaggtatctcctgcaatggacacaggtttgactttagatgctggtatggggctgactcctggtggtactggttgggcttactttctggggcagcaaggggtataggctgaggctagttggataaggatgaggtgtgcctgatgtccttggggtacagtccttcattagagaactggtgggacccctccccaacccactgagagttgggagactgaggagaccctggagggggagtaggcctccaaggggaagcagctgggaggggatcctttaggcatgaatttctgttgcctggaagtaacatgagccagtaaaggtctataaaagcctgtacataagggacctcttcccgttttctttcagttttagaaaagaagtctaattgtaaagtatcattataacatatagaaccatgtttaggccaaatgtgttggtttgccactttgtgtcgaacgcaaatattattgccatactaaatgagtttcttcttcttttagccaaatttgaatttgctccattggcctaaaacataccccagtggtgggtcctctgggatgcttgctgttgcacccatgtctagtaaggatctctacagagggttttggttagcctaagtttagtaaatgccaagttgctttttcccttttacattcccacttttcataggtagcaaggtgttacaaattagatcccaagctacaaaaaggcagtgggatgttgaacttaaattccacagagagagggttacacagaaagggaggataaacaaatggctgtggaagagagaaaggaaagggtaaacagcattgcccaaggggagacctcagaggccctgaattgcaggagaatttacccagtagtggagacaccaaaaacaaaaatatttggatggccacttgtctactgctgtaagtggctgtccatcaggccaggggcctaggaactcccagttcctttggccaagaggggcttaagcaaggcacttgttagaaagcacacaggaagggacttgcagctggctgttgggaaaataatacttctaactctaagggcagaaaaaggcaagaccaatattcccctagggggaggggctataacccaccatacttagaaagaatgtcagtgctgaaaatcccagagcatattggggggtggccaaaaatactaatgctgaaaacccagagttactgagtgtcaaccaatgagggtcccctcaccaaatgctgaaaaccttgggggcaatcagggggcagccaacagtgaacccaagaccaagttgggggtcacagaacagtgtgactctggcatcccagagtcaacacaacaggggacctctaacaaccaagtgtactgccttaattgtccactcacaattaacagaacgtttaaagcaaatgtaagagtgcacatcaaacacattttaaggcataaatcatttaagaaaataaaacaaatggtggagcaataaaatggagttagaagacaaaggacttggagaaggggtgacaaggacgtgtttcaaggcaccgaaactgtgaggaactgacaacttagccaaaggcttttattccctagctttaccaaatattatgaaaggaagggcagaggggataccacccattcagcagaaatggcacagactgtgggacctggtgaagatctctccaggatacctcagcttgggtgagtttggcagggctgcctcagagggagaggcctgcaccaatttggtaatccacccattactagtcagagaggcgggccccacacaaaccagatggcactatggctgccccccaccaatggactttactgctggggtgggagaggcctgtacaggcaggtaactgacagggctgcctgtcagagagttgggccccacacaaagcagacagcctcacagccgtctcaccgatgggctcagctgccacagtgggaggggcctgcatggccagtaacccactgggctgctggtcagagaggcaggtgtcacatgaggcagcacactatggctgcttgttcatctgatcagctccactgcctgccagggaaaatagtggctctggaaagagctttggtagtgacagacctcaagtgttacaactctgttttgctgcctctccgatcctcagtctgctaatcactttttgccaccattggctctgctgatcagtgtcccatgaatcctgccaattgctgcttcactgattgctgactgctgcctcattaatcacccactgccatcttctgtctttgccccatgttgggtgccaagctgatgcagggcaggagagccccagagttgagcttaatccatgaggattcttggctttgcccaggaaacaattcaagggcaagccagaggtagaaggaaacagctttattgaacagacagtgttacagctctggtggtgttgcagctctgtgactgctcctgcagagcaggcccatcccatagacagagagtagcagccagggcagttttgcagtcacatttatacccatttttaattgcatacagattaagagatgaaggggtggtttattcagggaaggggtggtaatcgttgggtcattgccatggaaagggtcagcaactctggggtatcgccatggcaatggtaaattgacattggcagtggtgggaatgtctgagtgaaagcttctttttacctggcctttttaagctggtcttcagtctggtccggtgtccgaggcctgcctctgtagttgagtcttgcctcctatctcagattgattatttgctgatgtttataatacaatagcactaaaatattttagtatttatttaaataaagattcatactgaagttttattcattaattaaaaccactcaaattaataactaaatggaatactgtcatttaaaatttttacgttacaaattaattggtaggagaaagaaagatttttgtcctgtaaaattgagtttagatattatttttaaaggtaactactcaagtccaaattcatcaaaatgtatacatcaaatatgtatatttttgtatatcagttatacctcaataaagtataaaaaagtaactactcaaaaatctttactcatgtagtataagttgagacaacttatccaagaaacattacttgaatactgattgtgacaaagcctggagatagaaagaggaagaatacatatttttgttttcatgtttagcagggaagaaaggaatttggaattaagtgaatgaaatgtcagcacatcaatgctgtactattaggaggagagagactctatgaaattaagaccaaaaaatcaatagatgctatctgtcctttgaaggcaaggtctaatattctttgtaatattgaacagcatattctatgcaaatacttaataagttattacagcaatgtaaatatcaggcagatattttcattcacgtttatataaggcaaatgcattagttagtgtaaagggaggtaatacataataataaaggtaacagtctatcaagaagacagaacaattttagacatgtatatacaacaccctttatataaaattaggaaaaattagaattacaatgaaaaaattagcagacccaacttcatagttgagtatttagcaaaatgctttcaaaaattaataatctttaaaaaatggaaataaaagctatagaaaacaaaatttacaagcttgaagatcaaattttcaattccacaaatacttgattgattagagagtgggtaacaaaactgtttaccaaattgtccaccaataaaatgggaatggacagattttatctctactcagtagaaattattgtaattaaagggccatgttgtacagagacaactggctataatagaattttgtccacttctatcttcatcacctaaaacagtgcctggcttatagtgggtgctcacttaacaattgctgattgaataacgaatgcatgataagtttggtaccgttttcatgatcatagagtagccagtttatatatatgattaagaaacttgatgtaacttcattatcatggcccaaataggcttaaaaaattgtttaccttacacacaacccaagtgtaaaatattttcttgtgtctcttcttggcccatataatttgatttatagcccaaattgggcacatttatagcctggagatgatattttttccttcagaacctgccttatgttacattgtatatactttcactttctccacgatatacagaggttttcataagatcattgcatatttacattgtagtagtcaataagtcaagagagtaaagcgagttctagatggaatagacgtatcatgtggagtatgtggaatgaatcagtacatggaggactcagcaggagcactcatgaaaataagattgaggaactttgaaaaagatggagataggtggtatgtttgacttatgtgtaaaaagcagctaataaatggagacaatagcaaatgaaaataataaagtaataatggaaagttttaagagtgagaaattcaatcagaaaggaaaacaactgagagtaaggtgattacattgtagaacagaactcatggtttagccaataagtaaaactccatgtaagtatagctttgggaataattaaggaacttatttccaaaatcatctttattaaggtatattataaaaagctccattttaattttacagtttcatgagtttggacaaatggatctcagatttaatctcacaatcatgactccctctgcacaatgtccctcatacctctaggcagcccattcctccacttgaggcctgataaccactgatctggtttttgtgattattgattacttttgtctcttctagcaaatcttaaaagttgaattgtactactcagcataagtgttttgagattaataatgttattgggtgtatcagcggttctgttgcataaaaatattctgtggtatggtttctttgtttcatgctgctataacagaacacatgggactgggtaattattaaagaacagaaatttatttcttacacgtttggaggcttagaaagccaagaccaaggtgcaagcaggattgttttctggttccaagttggtgctttgttggtttgttctccaaagaggaggagcattgttgtctttatgtgccactataaatcctattagtagtggcattaattctattaattaggacagaggtctcactatctaaacacctaaaagtcttcacctccctatacctccatactgggaaacatttagaccatagcatatggatggagtacaattatctttattcttgcactggctggtggacatttaggtcgtttccatcttttcattattatgaataaagctgctacattcatacacaagtctttgtgtggacatatgttttcacaactcttgggaaaataccaaaggatggaagtgctgagtcatatgccaagtgtatgtttaattttgtgagatactgccagtctgttttcccaagttgttagactattttctattcccatcagcaatgtaggaaatatctagttacttcacatccttgccaacacatcatagccagaattttaaattttagccattttactgagttaattgtggtatctcattgtgattttgacttggatttcgtgataactattgatactgagcatcaatttctctctctctctgtctctccgtctctctctctctctctctctgtgtgtgtgtgtgtgtgtgtgtgtgtgtgtgtgtgtgtgtgtgtgtgtgtttggccagacttgttttatgaactatctgttcaatcttttgttcatttttaaaattggattgcctgtggcttgcctttttacttttctaaatgaggtctatgaaagagcagaaatttttaactctgatgaaatctaacgtatttttttatgcttcttttattgttctagctaagaaatattttccaatgccaaggccatgaaaattctttctggaagatttatggttttagattttaagatttgatttaattttggtgtagagggtgaggagggttaaagttccttttttttcccccccaaaagaaaccctccattcattcaaaaatatatgccccttgaagataagaaaggcatgagttttagaaataagaacagcatttttggccgggtcctagtgactcatgcctgtaatcccagcactttgggaggccaaggcaagggaattgattgagctcaggagtttgagaccaacctgggcaacatggcgaaaagccatctctacaaaaaatacaaaaattagctagccatggtggtgcgtgcctgtaatcccagatacttgggagcctgaggcacaagaatcacttgaacccaggaaatggaggttgcagtgagccaagatcatgcaactgcactcctgcctaggctacagagcaagactctgtctcaaagcaaaaaaaagaacagcattttcatatatttctcagtactctcttgtacatttctctgttactaatatgaataatttagttatgaatattgaggtttatttttaaaattcattatatattatatgtaatgatataaaattcattagataacttgaaaagtatgtaattgttacagactgaatcttctctagatatttcattgaaggataatgaaaaatatattttgttaaatttctttcaaaaaagtactatttatttttcctaataaaattaatattcattgtagaaaaaaataaaattaaaataaagaagaaaattaaatttgaattccacctagatgttgccctcacggtaaaatgaaatttactttttaaattaatatattatgggcattttgtctttcataagatatcctttaaaaatatggttttaatggccacacaatattttatcatatgtctatatggtagtattcataactatttgtcatgaattttcatgtagattgcacccaacattttaccactgaataatgttattataaatatttttatgaagttatctttgaaaatgtgatgaattttttatgtaatggaaaggatgtttcaatatttttaaggatacataacagttttacatatttatgaggtacatgtgatattttgatacaagcatacaatgtttaatgatgaaatcagggtaatggagatatgtgtcacctcaagcatttacgatttttttgtgttaggaccatcccaattcctctcttctagttatttttaaatatacaataaattattgctaactatacttgtcctattgtactaccaaacactattcctttgatcaaaagtgtatttttgtactcattaactaatttttcttttctacccctaccacattacccttcccagcttctgataaccatcattctactctctatcttcatgggatcaattttttttaactcccaaatgtgagtgagaaaatttaatacttgtttttctgtgcgtggcttgttttatttcagagaatctcctcctgtcagaggagaatctgcgaagggacaaatgacatattctgccatttgtgattacatatatagaacaggacggtcttgttttttggttgtttcataaatcctttcttttcttcttcttaatgtttttctttatggatacataattttatttggtagaaagttttaatttcttggtatttgttttttgtgtatctattttaggttatgctttgtagttaccataagacttgtagatattatcttataatcaatgattttaaagcaatgacaacttttctctggtcacaatgaaaaggaaaaaataagcaaaaaaaaaacccaaaaactaaaaaactctacattttcattccatccccctaactttaagacttctgttgtctctacttatatattttatattatcgatctcataacaaattgttttagttactatttttgataggttggtttttagttttcctactacatatatgagtgacagtctgaagttacagtttcagggtattctgtatttttttgtgaacttacttttgccagtgagttttatactttcatatcatgttgtattgcccattagtattcttttgtttcagattgaagaacctattttaacatgtcttctaagaagggttgatgttgaaattctccctcttttctttgtctgggaaagtcttcatttctcctaactgttctggaaacaatactcaatattctaggttggatttcttttttttttttttttttttactttagcatgttgaatatgtcatcccattccctcctgacttacaaggtttatactgagaagcctggtcctagatgtataaaagtttcttaatatgctatttgcttctttttttgttgctgttgttgggattctttttttttttgagatggagtcttgcactgtcgcctaggctggagtgcagtggcgggatctcggctcactgcaagctccgcctgccgggttcacgccattctcctgcctcagcctcccaagtagctgggactacaggcgcccgccaaaacgcctggctaatttttttttgtatttttagtagacacggggtctcaccgtgttacccaggatggtctcgatctcatgacctcgtgatccgcccgcctcggccttccaaagcgctgggattacaggcgtgagccaccgcgaccggccccgggattttttttttatccttgacctttgggaatttgaatattatatgctttaaggtaatcttatttgttttgaatcttcttggtgttctttgttgttctacctggttattcgtgttttttccaggtttaggaaggtttatgttgtcatttctaccttgatccctgtctctatatcctctttaataaaataactcttagattatcccttttgaggctattgtctagattttgtgggattagttcattctttttttattttttcacccctgactgtatattttcatacagtctatcttcaagtttactaattctttgttctgcttgatcaattctgcttttgagagactgcggcatttttcagttcgtcacttgaattcttcatctctagaatttttgcttgatttaaaaaaattatttcaatcactttgttaaatttctctgagaggattctgaattccttctctgtgttatcttgaaatttgctgaacttcctaagacaggtattttgaattttctgtctaacaggtcacatgtctttgccaatcaaggattggtcactggtgccttatttagttaatgtggtgaggctatgttttcctaatgtccttgatgcttgtagatgtttgttgatatctgggcattgaagagttaggtatttatcacgatctttgcagtctgagcatacttgtactcatccttctttagagagctttccaggaattcaaaggggattgagtgttgttacctaagcttgtcgtcactgcagctctttcagcagtaggtggcccccataagcccaggaacactgtggctcttcacttaattaaatacacagtcttggtggatttggggaagacagagtattccctgtgttcctaggcaaagcctcttgttttctgccctgtcttttccccaggcaaaaggagtttttctccatgtggcactgcctggagttgagggaggggtgatgtgggtactcccatggctctcacagctggtatcatgaggagtcacacctgaaaccactgccttccagagcagcacaatagtggtgctcacccatggaccacatctactactgtctgtctgccccggatatttttgtcaaggcccaaggctactttagtcagcagatggtgattcctgctgagacttggtccaacctgtcagtgcagtggattcccttctggcccctgatgggtctagaaatgcccttcaggagcaaaggtcgggaattaggcacttcagaaatcttcctgataatttactttgctgtgagtgagctggtacccacgttgcaagacaaagtcctctgtactatcttctctcctgacccaagcagaaagagtctctcccagtgctgcacagcctactcttaggagggatatgacacgggcactcacttggccaccacagctggtgttgctctggtccgtaccccaagtccactgcctctgagaccagcctagcaccagagctggaccaaggactgcagtcactgtggcctggttgccactcaaagttatttggagccccaggccattttaatcagtcactggtagagctgactagaattcagtttcctcccactggggcaaaggatacctctcagacccagtggtgttctaagtactccgtctgtgagcaccagcagaatttttccctgtgttgtgctttactgtgacagaatggccctggcttcaatgcaaagtcccacacttcctttgctgtcccttcttcaagcacccagattctttctccaggctgtgcctcttggggttagagtacgggtgttgtaggcaatgcaaaactcttcttcctatccccttcaatgcctttttctttgttgctatgttgaacctaggtatgtggtccttacctgcttatctggtttttatgaatgtgcttccttgcatggatagttgttgaatttgatgttcctgtgggcaacaatctctagagggttattttggtcagttcgttctaccttcctctgaaaagtagtttctgattatattcttagactggattattggtattggattaaatttttaaagacatgaatattcttttaattctcttgagagaaactttcactgctttaaatatccttgtttgtaatagtttaaaacaatagtttaatagttttaatagtttaaaaacaaggctattgatcttcttatctcatcatcagtatgtgtatacatatctcaccacagtatttatcatttcatttaaacacatttgtgagctaaattactttaaaatcagaaattctttgagtttttctttttttagttttttcacattgaataatttgatctgtatatatttttatttagagtaataatgaggatgaattttaattttttgataatgattcacttgtagcatatattgaattgtctttgctctcattactttttgtaatgttaaaattaacgtgtagaaaatctttatgtataccagggtctgtatacttcaaagtctgatccagatatgatctcacttcctccattttttgaggattaaagaggtaaactaaaaaaatgcattaggcatcacaaaggcctctagagaaaaatattaatatacacaccccataatttacctgaagttaatagtttaaaaacaaatctaattccttcaattagaaaaacttaaaaatttttttaaattaaaaattacctaaaaaaatatgtgatttactttttagaagacttattctccttttaggttgcaataacacatgatctctatttaaacattttgttcaatatagaaaaatagaagaagaatataaaagaacttataagtccaatacatatagattgttacaattataatcttggtttattttttatatttataatagagatcttgctttatttcatttttacatcctgcttttattgtctgaatttatatttaggacattttcttacagtattaaattttccttaaaccacagttttactgactgtacactattccgcctattacagtttgcttaaacattttcctctggattttcaaagggatgataaaagtttaaaaatctttctttactagttcctcattcataactatcattattttctgccacatagtatagttctatgtgttttcgttttcttctttaatctgtgtgttataatttatttcattattattttacttatttggggcatgcctaatcctacttactatttattattcaagatgtgagctggacctgaaaagatggattgctgaaggtgagagattgttcttaaggaaactggcactcttgttgaatttgaaggtttatgtgcattattataaacatattcaccattattagagctaccacttattaggtgtttactacgtagcatgccatgaattcaaagcacaagtgctgtatcacttagttttcaaacatcgctatggagaagttcagacagaatcatcttgacaaaattttctgtactcatggtctctgaattcagttcacagtttcttttgtaaagatactccaagcagcttcttttcaccatgacttcatcagaaatgcttttattaataccacttattgtttccatattgctaagtccaatgattctcaacctttattttacttgactgtcaataacatctgaaacagttcatcatccctgcctccttgtattgcttttgttacttgtcttagaggctgtcacaccctcctggttttctacctcactgacgacttcttcacaatatcctttgcaggttccctgtcttcaccttacctcctaaagttgaggtaggccaggaagcagaattagatttatctgttctttttctgtacttattcctttagtgatctctttgaatatattgttcatttatatgccttatcataaatttatcacttcaaactttacatagccatgttatactcctctcctaatttttagacatttgtgaccaaggcttacttgatatatctttttggattctaagaaacatctcaaacttaccatatccaaaactgaatttctcatctttcatcaaaagcttttctctttgccatcttttctgtgtcgatttttggcagtttcatcactccggctgcttaaaccccaaaatttcagatattctcaacttttccttttctctcccatttcacattagcacatcctgtttgcattattatatgcaaactttctttaaagtatatttagaattcagacttaagtcagatcatgccattcctctgctccaacatctttgctagctccccaatactcagagtagaaacaaaagttattatgatggcttactcaagttctgtgccttgagcactggagtcacattgactttaggtcttggtattctccccttattcattctgttccagtcacattggctttcttgctattcttgcaatgtggcaggtatatttctacctcagtacctttgtcttgctaactcttctgtatgtaatgttctttctccagtttacttcatgtcttaattttctacctcaccttattcaggcattatctcaaatgtcagtgactcagtatagcccacatggccacactatttgaaaaggtaaattgttccccatctctacactcgctgtccttcttctctgccttgtttttttaccactgtatttttcactgcatgacatattatgttttacttatttacattctttcttttctagtctccctctctgcccaataacaatcctgtaagtctattttactgctgtatctccagtgtctagaagcgcttgacacatcagatatgtgaatgagggaaggaatactgagtgaatatttgcttaatgctgtcatgatagaagaatctgcagagcaagaattcagcttttgttccaataataatttaccactagagagacttatttcaagaatttaactagaaatctatatacaacataaacagaatataagcatgcaaaatttatagagaaagcatgaagttttccaatataggttttccaacaactgaaagcttcacaaaatttgcttttatgatgtaattttatagtgctgataaaaatgcatgcattcttataacctgtaaatcttttcatattttatgcaaattgataaaatatatcataaccattataataggttgaatagtgtcccagaaaaaaaatcatgtcaacctggaccctcagaatgtaacattatttggaaataatgtcttctcagatgtaattagtcaaggattgagatgagatcatacacaattagagtaggctctaaatccaatgaccagtgtcctcataagaggagagaatgcaaagaagtacatagaagggagaaatttatgtgaaaatgaaggcagagagtatagttatgttgtcacataccaaggaatgcttggggtcatcaaagaagatgaacgagacaaggaaggagtttctcctactgcctctggagggagtgcagccctgctgacatcctgattttgcacttctagcctccagaactgtgtgagagaatatgtttctgttgtttttttgccaccaagtttgtggtaatttgttttggcagccctaggaaacaaatatagcaactaataacaatttttcaaatgttccacagtcatagaaatacaggaagagtcaaaacatggcttgtcccaaatcgcaaagtgattcagtccggatattgatgtgacactaagaactctttactcctggttcaagatgctaccacaaatatccttctccatctttttaactttaatattaggataaacaatttatagttctataaaaatataatacttttttatggaagtccccttattagaaaaacaataactacatattgagaatgtataacatttaccaacttatataagtaggctgctgcttatatttcataatttgcagtcattacttctaatgacaaaaatgctacagatgaattggggatgatgtcataatatgtgcatgtaactctatattaggtacttgctgtacctaatataaaatagtgtattcatattaatataaggaaatttattgcttcagcttgtgatgcagatacttccctcacctaacatagagttatatgcccatattatgacatatatgtcaaggtatttcttcctttaatgaagtggaacttactaatttaggtaattcaggataacctatgaagtggcctcactgatagaatttgtgttatgtaacactttagagttagtaatcctgtgacaaagaataaatgaaaagaatgatataaaggtagtcattgagttttagaactggtcacaatcttagaattcatgtaagctattttcaaacttctgaaaattctcaatgacatagaatacattttcaaataaaatctcatgtaaatacaatttattaattggtaaaatatttaattcttctatgtaaagaggggttagtcgttcatagccccttttttttcctaacaaggaaatagagatatgaggaaagtacatcaattatcaaagttagacaagtagtagaggccaagataaaactactgagagctttgaggattctgacctagagctctatttaaaaattacagtgatcgtgaaaagacctctataatttacaaccttgcttttgatctcattaattttatatctttttctgaaatgtgtcaacatcatcctatctgctgtgccaaatatcattaagagttactgatgtttacaaagaattaccacaaatcctttaatacactatttttgatgtactggtggaatatattttataactcagttactagcaactcactgaagatttctgcaatgccaaatttacagtaacccatttctcttctcaactcatatagtaccttatctaaacttctcccattataatctttttataaaaattataaaatttttagctatttatgtgcttttctttttttcttttttttgtgccttactgacagcagtttgagttcagaacctatgattgatctgtgatttaaggaaagcatctaacaaagtatctttcatatagcaggtacagaaccaacgtgaatgactaaactttgatgtagtttggacatcctttcctccttttactttttagacgttctttgaagatatttaagtaagttttttaggttattcacatgcgcacctagtggaattagatgaacatgaccatatacagatgatcttgtcttaccaagtgaaatacagtgtctggtagagtctgttgatgatggctatgaacattgcatgccctcaataaatatttcctgaatgatcatttgtaataggtccacatctcaagctgaagaacaatttgatgttaccaatgatttatagacttttactttgaactagttcctgaaattatcttgacattgtgctttttcctttgaaccttcttgctgccttgatgttcttcccctaccaatcttttctccacactgatggcagataaatcttcctgaaacactattttgtggctgttacttgcctgctcagtgtccttcaataatttccaactaacggcagctctaagtcataactccttactttggcaccagaaactgtctatggtctggctagacatagtcttagcttcaaatactttcctaaatatttgctgtatagtggttaacaatcgtacttttgtatgagacagatttgtattttaatcaatctgtcattacctgaaggtgtgaccttgttaaattcatttgctattgtgagcctcagttttttcatcttgaaaataagaataatgaccacatggatttttattccttccttcagtaaatatctattgagtgttttttatgtgctagtcacttctgtaggtattgggatgagtcaataaagaaagtaggcaaaattattttggagcttgcatgctagtggaggagataataaatataacaaataacctatagagtaggctaataagcaataaatgctatgtaaaaaaataagtggatatggggctattaggaatggaggaagagttctggagaagaggaaggatggaaatcagtctaagcataaatgagatattcttcctgccttgatttccagaagtcatggttaccagaagaattaagatttttagagatagactaattcaagcttcctattatttgttctgtcactaggtcctaggaaattggagtcatgtgtaaggaaaagaaagttggttttgacagtctccctatgtctttgtgatgtaaaatagtctagaggaaggaaatctgaatgttttttcttaagtgataagtgggaaactttcacaatcttgattagtgtattatatgggtagcatcattagaaagaatggaaattattttatacccattcctttatttgcatatgactgtctttgttgttttctttgtgtttgggtataaataagcaaattaggtaggaaatattaaaaagaatttcagcaaagcttttattcttaattcaaggaaatgtattttgacattaatgttttttaaccctcattattaaccctgtgatggcatctcttggccttcttatcatgccttcaaatgtgtgattattcattcctaacaatgattacatgtcacatttacctggaggatttgaaaacatgctttttcttagataccattcacccctgctccttttttactggtgctttaccaaatttctcagttgattctaatatgcatcctgacctgagaactactgacttacatggtctggcacatgcctctctctctaaccttatcacctcccattctctttatcacttgcctttctctgcactcaggccttcttttcatttgcccaaattgcaagttatgttcatatcagtccctttgcattttctactcttaactactcaaaatgcttttccacagagtcattcatttaacacttcaacacatatttgttaattaatcacctattcactctaccgtggatgaaactgaaaaaaaataacaattcttcttaatttggctgctttcttctcatcattaaatgattcaatagagagttgttggccaaaagaaccaaagtttcagttacacaggataagtggggagatgatgtatagcttggtggctacagttcagaaaactgtgttgcatacttgaaatttgctaagagagtaggtcttaaatcttctcacagcactacacacacaaaaaaacggtaactgtaaagtgatggatatgttaattagtttaattgtcataatgatttcacaacgtatacctataaaaacatcacattgcacgtcctaaatatatgcaatttttctttgtcatttatacttcaataaagctgggggaaaaagaaaaataaataaatatcacatcccaacatacctcacctgaccattccagctgacattgccacttcaaaattattttgtcttccttattttatgacagctcttatcttgttatatattttgattttgtcttacgtatgtatgtgttattgtgtttacaacctgtagaggatatgttctataaaagtgaaaatttgtatatcttattagccattttatcctcagtgcttagattagcattggctggaacataatgggtactcaataatcaatcaattaattaattaatcaatctgctttacaatgtaactaaatgtggtttctgtagttcctaaactgagtcttatctaccatgaagatactgaagtttaaggtttagcacccattttaatcatgaatcattttcaatcaattttatctttgtaaagcagtccttcaaaattcacaaatttcaagccttataataaaatctggatgtcttctgttcctaaattttcttccaagccaattaggtattagtttatcagaataacatttgttttatttcagttaaagtagtaaaataattttgctctaaagaacaagctatattggaatcatgggttgagtgaataaaacatttggaaccaataataaatggttgaggtaatagctcattttggaaaacaaaagccattcatttagcttttctcgtagaaatagatttttttgtcaatcgattatgttgggttacttataataagtaacatagtaaatacatttaattccatattactaagtgattaattcccacagcacatttgatatttttagaaaatttgcatatttttgtaacaattggcaaaaaattaatatggaaacatgaaaaattattgatatgggtatgcatttaaaataaacttgagcttagttaggaaataataattgaaataattccatctacacattttttaagcacttgcactatacctcctctaataatagagggcatactagtcataattgaactgataaatcattttatctttaagttatttttaatattgcttttgtcaataagggaatatttttctttgagaaagcaatgaaagcaagctttgtgcttgacataaaatctaggtgtagtaagctgtcattcaaaatcctttataatttgacttaaataaacctttccatcaactgcctctcaaggaaagggtactactgacttattcaaagcataaatgattcttttatgcctgtatacttgctcatattattttatgtctagcattaccatgctacttgtattagtatgttctcatgcagctaataaagacatacctgagactggacaatttataaaggaaagaggtttaattgactcacagttcctcaaggctggagaaacctcaggaaactttaaagcagaaagggaagcaaacacatccttcttcacatggcagcaggaaggggtggtgctcagcaaagggggaagccccttataaaaccatcagatcccgtgaaatcactaactcactatcagaagaacaggatgggggaaaccaccaccatgattcaattacctccacctggtccctcccacgacatgtggggattatgggaactacaattcaagaagagatttgggtggagacacagccaaaccatatcactatttgaagtgtagttctcaaaccagcatcatcatcattatctcagagcattttagagaaatgcaaaatctcaagtcccactcaaacccacttaattagaatctgtatattaacaatatatctgagttattcatatgaccattcaaattttaaaattaaggtccaaaatgcccttttcattaactttttaatttttgaaattctaacttcttctcaagactatactcatatccactacctattgaagtcttccttgaatattctagagaaatacgatctttcaatcctgggaattattgcattaaaaaaaacagtgccttcaattacagctgtttgtagataatcttcctctttgaggatgctattcatgcctcagctatcacctagaaaaatagatttaatagcttttccaaaaatgttgtttcattaattatagtcatgctttccaaaacattacaaatgaggtactgaatttaatgcaaggtaaatttctcagagataagaagatagaatattgtctgtttattccctaaactgctgctttcatgctaggattgcaggtcctcagggtcagaaactttctttctacttcctgaaagactaagatagtagcataaggacagaaaattgaagaggtttcctacattttcattatgactgaaaccttgaatcatcatctctacttgcattcagcctgggtatgaatttttgctttcctctttgttttgcgtgacctttgtcaagtatcatagttttctatgtctgatatggtttggctgtgtccccacccaaatctcaacttgaattgtatctccttgaattcccatgtgttgtgggagggaccctggggaggtaattgaatcatgggggctggtctttcccatgctattctcgtgatagtgaataagcctcatgagatctgatgggtttatcaggggtttctgcttttgcttctctctcatttttctcttgccaccaccatgtaagaagtgccttttacctcctgccatgattctgtggcttccccagtcatgtggaacttgaagtccaattaaacctctttttcttcccagttttgggtatgtctttatcagcagcatgaagatggactaataaaatatcttgtttctttatctattaaattgagctgggcatggtggctcacacaggcagtcccagctacttgggaggctggggtgggaggatcctttgcgcccaggagtttgaggctgcagtgagctctcattgcaccactgcactccagcctgggtgacagggcagctgagctagactctgtttcttaaaaaaataaacaataaggaaagataataacaatacagtaatatgctccttacgtcataggtttattactaggattaaattatgttacatctacagaaaattttgcatagttcttaatatataagaaacactctgaaaggttaataacaatagttattattattatttgattattttaaatctaggttacttttattgtagctatccaagaaaagctcacacacaatttcttaaaataaactatttaatttacatttacttataatgaattaccccaaatcaatagtgttgtactttgaggatggttgtttttcataaatcttagtgattcagctagccacacttatttaaataatatgctgggttgctgaggggcacaggatcaaaaattaatgtggcaataaaggcttccttgcttttgaacagatcaatatctgtaagtgaactagaggcacttacaactaaatatccaggaatgaattaaaaatagattctctgatgcttgatggagttaaggatctgagattatggtctttgagaaacttagtgacctgaatacatattcctcttctaccatcctccttttctgcaatactcatcaatttcaataggtattgatatgcctggttgcataaaaggacattgaagagttgagctctttattctaatagcttttaaaatacaaatgcgcatcataattattctctagtagaatctttgtatataacatcatatgcacaaataaaacatttataagtatgattataaacattcttcaacctcattacagatctaaggaagctgacaaagagtaaagaagggcagattcagcatctacgtgaggctgatatgtatgctttttgccgagacaaaaaagattaaaatgtttaagcctcgtcaaaagtctgtgagaaccaaatgaaaggtagattatattcttcctcatattccagattattatttactaattcaatggatagagactgatggaacactattcagtgcaagacattaagttatgtgctgtgatatgagagtaatccagagagttcagctaatattaaacttaaaagttaaagacagaattgcatgttgaattacaattgtgatatatatgatagcatgtaaatggataatatgatctcctttgtgccaaggccctaggcaaggaggaattaacagtattttggagacagggagaatgctaatactgctggagcataggtggaccaaggaggctagtgacatggtcaaatcattgtagacaatattaagagtttgtttttaattctaaaagcagtggagcaccactgaaggattataaacagggaaccttaaacactagggtcagatatgcactaaaaaggattactaattgctatgtgaaaaaatacgttagagagcatgaaaagtgggtgggaaggaagacccgttaggagatattagagtagcttggaaatgtacataatggtagcctaaataaagttagtgaaaaagagagggaataggaagagtagactgaatcaagaaagaaaggtttaggaggagtaataggcatagtttgggatgtttgtaaattgtttatgaggtgtcgcgtgggtgatcatgatctttgctaagaaaatgagtttagtcttggataggttgcacttgatgttccctttagagattcatgtaagagttttgagtcggcaattggatacatatttctgaatcttagagaactaaggggcaactttaaaaattgaaaattcttattttaagacagatgaatggaaaaacttctctactcatataaaccttttaaatttgtcttctcatgtttattgacatgtgagtatgaaatagaggtaggcttccaaataatttagtcatgcagtggtttgcaagctttgtttcttaaagccgtaaggtatcgtgaaggtggctcagaatacctcgtatattgaggagatacctgtgtataggaagccaggctcttccttttcaactaaaggagctttacttttatgtaagttgcaatctcaaatgatattttattcatttaaaaaattttaaaatatctttattcacgaatggaaactgtctgctacattattaaatagtgaggtatctcagttcacaccctaatatttgagaatgaagccatgaaaggcaactatcataattatctccaaaattatttctttaaagactaaatactagattggagctactgcttatttggtctcatgcaaaattgtgttcatccttgtgatattttagaaatatagtttttttattatactttaagttctagggtatatatatatgcacaatgtgcaggtttgttacatatgtatacatgtgccatgttggtgtgctgcacccattaactcgtcatttacgttaggtatatctcctgatgctatccctccccactctgcccaccccataacaggccctggtgtgtgatgttccccttcctgtgtccagatgttctcattgttcaattcccacctatgagtgagaacatgcggtgtttggtttttttgttcttgcgatagtttactgagaatgatggtttccagcttcatccatgtccctacaaaggacatgaactcatccttttttatggctgcatagtattccctgatgtatatatgccacattttcttaatccagtctatcattgatggacattcgggttgtttccaagtctttgctattgtgaatagtgctgcgatatagtttctagaaactataggcaaaagttgcttaaattcacagtttaacactttgaattttgctttgtcacctgagaccagcaattcattgagccaggttatctcctttggctttcagaattttttctagctcatggtatacagatctgttgtctatatccaacagtcctctctcagacatagaatagcctgatatgtatatttttcttgctagttatttttttctccattattattattaatttactatatatattatcatgtctattactataatgtcagttgtggcattagtgagtagtcttgtcctttttcttgctatgaagggcaaataattaccacacaaagaatgcccctctgctagaaactgaaaggtaatttcagctttctgatgctctttcaaactgacactcaactgtaacaaatgtgtgctaggagaaattaacattttttctctcatatttcactataatccacaagaacaaacacagtaccaacatttatcattttagttaagtgaaatgctaggaatcaaagtgacaggctctgagagaagttatactgtggaataaaactttatgatccatttgcaaggacggaaatgtacttggctcatcttagtaagtaaataatgctaaatgtatttaaatattgatctgttttcagtggaagggtgaaatgaatttcaaaatatagaggctataaatgtatacaaagcattttctactgtactaccaatattgtgctatgtcactttacgaatctgtgagtaagttgctgaaaactgcaaattttgttataagttgtagtagtcatctatcaccaagtttgtatgttgaagtcaatgtacctaagggaaaatagtgacagagacagattagtttctgcatagcatctgtcagtgtagatagctctcaccattttataggtgagaagcttaactatctttaacaggtaatataggttctattctaagatccactgtctgtttcctttaacaagcaccgtgatgaggctgtaacttctaccttgatgtttggagacatgttcaataatcttgagcaaacataatacttcatttttatttttcaaaagatttacaaattatcaaataaatttaattttatacaaaaataatcccaaatgacagacatatttaatctgtctggggaaaaaaaagaatatgcaataggaagttttggtattttctctgccgtggtgctgaggatatttaagttaccgggtatatttaaggtgctgagaatttttgttagaatttgaagagaaaaacacagaaggactaaattttcttaatgtattgaaacaagaactatttttatctggagataaattagacaataataacaattttataaagttaatttatcagaaaactaaaaagcgatattgaaataagtctattctgtttataaactaattctgtcttgcatagagtgaaatttgatgtgaacagcaagtagcaaaatttgctgtagtttcttcaatgtttgctgaatttttgagtaaatatgaatgttattttaatctttatgaattctaggctgagatagaattttcaaagaaatctgatgcagggtcttatagtagcttagaaaatataattacttacggtatgaaaatattatcaattcattcaatttttttattttaaaaaacgtatctcaatagtttctacctaaaagttgtgataaatggtaattaatattgatatttatttataaactctttaagtattagaaaccacaacttagattttgcatttaaaataatgtaatttaattctcttccacctcttctcttcctttaatttttgggttggttggagttatctggtaaagtgaatctatgacatacactgaaacgttaaatggatggttttatgtttgcagtaatgaaagatttaagctttaagtattctctcaaactctgatttccaaaaatgaaaaattaaaatgagattccatttgcataataaagtagtgacaaagaatttgagtgtaatttatttcattgcaaccctttatgtccttggcattctatctcattacataaacatgctgtttaacatgtggcagtgtgtattggtctaaatggtatgaacatatttcattctgtgccctttgtattgtgccatactggcattttcaataaaggtatcacttaccttcttccttctggagaaaatactgtgcttcttcctaaaggaaagcaaagataatgtgagaacaagacaggtaaatgtttaatggtatcacagaactgcaataaattttgctcgttagcttaaggaaagatctatcatattttattatacctgtcatctttaattttaaagtctctttctataataaaattcttcttaagtgaaatccattcagtgcttttttttttatttatagaagctacaactttagaagtttaatgaaatacccaattcttaaactacattgtcatcatggaggttgtacaataatataatctgtttttgagttcttgtgtcttaacatttatttggaatttgaaatgaaaaaatcataggttgggtttattgcaggcttaaattatttttataattgactagattattggcaatagttaacatcttcaacacagtcattatgtgtgcaatcttgtacttgtatttgaaagtgtatttaggggctatatagtaaaggatactagctccagaagactgtagtatactaaaggtatccagagaagttaacattcaaatacatcctaacagtgaaatttggagagaccaggtttctatcacttttaatattatttaaatattattggaattatataaattattttttatttttatgttagatcaaccatcttttaagccagattgtgagttatccatttggttattttttcctttaatcaattttattgaagtgtaatttacaaacaatcatattcaccaattttaagtgtgcattatgatgtgttttgacaaatgtatacagttatataagcaacatgatgccctcctctcaccccaagtccaggaatttactgatctatttttaataattatagcttattgttctacatattcctgatgcttctctttactatttgttttatatttcctctcttttttttcattttggatagttttcaacactatcaggttcactgatcttatcttctgcagtattaaatctgctgtgaattgtatccagttctttacttctattgtatttttcatctctacaaggagttctgtgataaaatatgcataatttttcgaatgactagggggtcaaatcctgttgctgatgttttcatttgaggaagttccttaattattcagtgccttgcaatcttttatctgaaaaatgggaaaacagttccatctgtgttgtaagatcaactacaactatctatatgtaacacttaaaagtaaaaagtaaactttctgtaagtaccaactattatttttattatcagttagtatttatgacttattaaatgcccattcttagaaaaactaaatatgcctattatttgtaattctcagctaagcgcatcacgttcctaagaaaaagacccttacatcctacttaactcgtcttccctccaaaatgtaaatgtccatttctcctgaagtccatttggctgcatcctgcccagactcttatcttcactgtaatacatagaacataccttttctattgttattgagttgtgtcaagaatttccttcctgttcagttgtattcctcttgtatatcaagctttccattctactttgataatttacatatggattccttttcataggactgtgagtgactggagagaatggattttcatatcatttgttctattttcagcaccaaactcagtacccggcataatagttacctcattctgaaagacaaaataaataaataaataattataggaaaacaaacacattatgacagttttagtggactccatcagcttaatacattaatgggcttgcttcttacctgtcttggccagctgtgaaaatgaagagctgaccccaaccactgcttgacatcacatgaaaacatgtcctgactgaaggtctcccagaagagttccaggcctatttgcctgatgaattttcctgtttcattatttattaaaatgctattcagtaggaagctgaatttgatgatagtttgcaatgttgcatttttattggaaatctttggctgtatttagtttccttggtgtaagttgttacgtgatctcagcataattgttcaggtcagagcacttttgtccttttgtggtagttctgaaactggcccttggccagatttataagtgtatctacaagaagtatgaaattgctagatagtattatcagtgatgaggtacggaaatatcgggcatgagactatctgactctggcagtaaaaagactgtaactctgtgactttgcctccttttcaaatcagtacctcgtatttactttatatgctaaagagctggcttcaaaccgtcaaatggtacatgcattaacatggagaaggtttattttggaagaatctcatgtagaaaaggcaacactttcttttaaaattttgacttctaaatcagaggaaaaatgtgtcatactcaaaaatatatatccctcatttaaaacaaaagagaaagacaggtattgttctaaatgagatattcctgggtaagtcagatatcacacagtaatcaataagtgctaggattacaacagtatacttggtcatataatacacatccgcaatattgatactgggatttgatagttatgcttttgaaaatcactacctggagtcatgattttggcagcagtttctcaattcgaatttatggacttcacaattgtaaagttgctttgagtagttattttttaatcccctgccctcaaatccttttagcccaagtttatcccgatcaccgtgacaagattttcatgtcacaatagaagactcttttctgtactagtgctttaactagcaaaacagcctttgtttgttgaaagcctctgaaagggctcagaatgcctacggaaatgagtcatattgggtgtaacaaagtggatgaaggggagaattataagagagaactatgaaaagctgggcaaaaggctgctcgtgcaggatcttctatgtcctggtaaaacttgtatttcatctgaagtacagtgggaagccactaaaaaatattaacgatagaggaagggaatgagaagaaataatataatcagatacacattttaaaatttttccttctggatgttgtttggcagttagtttggagggaaataagagaagcgtaagagccagtaaacagggtatcacagtagtccaaagagaagagaggaaggtggtttgaacttaggagcaagggattcgaatgcctagagttgatatccatttatacacacaataatatgtcttggtattagattggatctaaaggataaaggagtaggaagaatcaggatgagagccggatctctggcctaagcaaatgtttaaatgctgatttcatttaaataaaatcgggcaagtctgtgggaagaagaattggctgggagtaaaaagagatagggttcttgtgaaactcaagttcgttgttgtctgttggatttgagagcctcataattcatctaggtggttaaattctagtctgggcttaagggagaggggcctttactgcctctatcttggaaacaagacaactgttaagcaagaaggtacctctttagatacaaagtagataaatattattagactcaatcattgtattgaatgatctcacgcttcaatgggagagattaaatatgtatacacatgttaaatgttcccatagtaaagcctagtcttatgtttattgtaatgaatttgggcatattaacttatgaaagagcaagaagctagggattatattagtctaaggcgtctttggaggaatcatactacaaaattaggtgctgacaattgacctcaaagacttgaccacatagacaaaaaaaggaagatagtttgccctttaacttcctgggcatggcactagataggatgataactcaccctgagttgggagataattgacttcaagcatctttgcagagaaggatgctatgaaatcatttatttagttttctgaccaaaactattgcattatttgcaacagtactaaattaatagtattgatcaaataaaaatagttgcaatattaaaaggtctgaaactattcctacagttaggattaatcccataagtattcgggggagaagagcaccatagaacagaatgttttaaaaactatttttaaattaatattgttttgacaaataattgtatacatttgagggtaggaggtgacatatatatatatatatacacacacacacacacacacacacacatatacaatttagaatgattaaatcaagttaattaacatattcattgcctcttttacctatcatgttttatggtaaaacatttgtaatttactcacctggttatcttgcaatatactgtacgttgtcattgactatagtcatcctgctgtacaatagatctaaaacttattcttcttgtcagaaactttgtatcctttgctcaacaacttttcattccctctcacctgctgccacctgcccagccgctagtaaccaccattctactttctacttccatgagttcaccttttttggattctccatgtaagtgaaacaatgcagtctttgtctttttgtgcctcgcttatgtcacttaacataatgtcctccaggttaatccacattataaaaaatggtaaaatatcctttttttgaggctgaatagtattccattgtgtatatacactgcactttccttatccatttatcttttgatgggcacataggttgatcatggaccataagttttaaaatatgggcaacattggaataaagcattgacggtgattataagtagctgatgttatacagttgtcagaagcaagggcattggtagccctcttgagtaatatgcatctatctaaacccttggtgaaaatttaagaggatgatgaggatctaaatacgtaataaaagtgacatatttttaagtctttggagtatttatttatattaagttcaggtgactaaagtatgatttttttgcataactcaggaaataaattgagccaagtaaacagtaaatgccagagatggtagtaaaaatggagaattccttctctttttgaggttcatcatgttgaatttaaattgaaccttaaaagtgggataatttatgtcaaattttgttaatctcagccatgccacatgcttgtaataatagatagaggtgcaattaaggagtaaagttacatattactgttacatttttccagtgccttaagaatgcctgtatcctctcctagtcaaacatttcaaggacatttctaaagaattaatacaaaatgatataaaattgagtaaagcaatactttatgcagctagatttaatcttgttaaacatgcattaacttattttttggcctatataatctagaatcaacatacggtcatagatctgcattgtatatgtttcaaactcttaagtataaacctaaatctaaaatcatatccctctactgcttgaaaaggccacatcctttaaggccaaaaattaagagagagtggaaagttcttagtttgcctgattaattatctatattccctcctttaaggcaccaatcatgatatatatgtggtctaaatacgttgataaaagccaaccaatataattttcctcttttgggtttgtgtgcaaggaatcctggagattaaatgaagagtacttcgtctttgaagctaacttaaaggcagaatttagatatctgcaaaaatgtggaagagtactcttggcaaggtggattacgtaaggaaaggtatatgggtgtagcaaggcacagggcaattccagggagaaagtgaatatcacagataactgttgagcatttgccatatttatgcacactacaaaatactacagcagtcaaatatgcacgttccttttcctgctctcatatgtcagggatttagttggaaatgctaggaagtgaaagatattgattgaaatgatgttttaaggcatgttgatatgatctcagaatgcatggtgttttgggtatagaaaagtccagaggtaaataaatttgtcagaagacaatagaattaactccagtatgaaatggatgctatttaccttcagagataaaacaaaacaaaaaaggatcaacaacatatgacaatatgttggttgaaatagaacaacatatcgaagtaatttttcttatcccagaggagtcatagagtaacataagtagcatttattggaggcagcttatgaaaaatagttctatatagtattagtattctttcatttaatctttctgtagactggtgctttttttcatttctgttcatcagatgtgaaaaattaaggcctgaaaaaattaaataacttgctcaaaatcagacaattagtagatggtagtgttggcattctgagtcaggcagctatcattttaaaaatgatgaggaagagaaaaagatgtaagaaaggtgacaagttgtcgcagaagaccaacagagaagatatatttgccaatggtgtgttctttgtgttataatttgtatttagaagactttcccacacttaattatgtggattgccaatgttagcatcctgtgtctgtggtataaggtctacttgtaaaaaataagtgagtaactaatatgcactttcagttttttagaataaagtctttacacatttaatgcagaaatgaaaataagtcattggagaatgataaagtttagaaatccttgttacaagggaattacgctctttgagtcgtattttgagaatgtgtttcagagtctggcataacattcattacattgagtggggctctgtgactttgaaaataaaacaaaagagtaggtttgagaatatggaatgataaatatcccaaagcagtgttagcaacaagtctaaatgaatagtttaatgtgcactttcctagccatacagcttacaaagcaaaactaaaaactttcttctgcaaatgtgaactagttcagatgaatattttagaaaattggtgtacaaatggtgatagctgttgtttcaacatttgagaagcagattgaaacacaaaattagctattagcctacagcttaagtactctctaggaagaagaaaacaactgaagctagcaaattgactttcatttgggatgggtgcccatggttctgatgaaactctcatgcagtaacttccaaatctctggggacatatgttcaactgacctttgggaagtagagcaaagagaagctgggcagctttatacaaaatcacccttagcatttcactcagcaaaaccttctccaccagaacacagcattgcatagatttcaaagaaattgaagcctaactgggagaagaacataataattcactcataatgtttggaatactgtttaacacattccaataaagcactggctgggcagggctagattgtgatggagcaaaaaacgtgagaatgagctgacacctggtcaaatcgaaggattgaggattcagggacctgaagataagcctgaatagacagctggagtgagggacaaggaatctggaaattcagtccgagtcagatatattatgagatgtgaggctgcgctggagggtggaagcaagatttggaagagaaaagagtaaacactgtccagaggttccagtgaaggaggagtgtatgggcaggaggatatacaacatgtcttctttagggattaggccttgattcttaaaaatatataatgaaccatcattagaacactctttggccactttacaagaaaagaatgaacttagtgtaggtatggtagtgaggggcttattaactagtggtaaatatagacatccaagcaaataattacactgtattttgttaaacagggacaatagtatgaaatggttaaaggggataggcttgactatatttaattctcatttctgccattactggttgtgtcaccatcaagaaattgtttaatttttttaacatctatttatacttacttaaaagggggaaataatattatcagtgttactgggctgttgttttggatcagggtgttgaaggtcatcatcatctgatgatcactcctattttactaaggacaagcttgtacttaatgccaaagagagaaataaataatgtgaaaaggctgctgctggtgtcaacaatgtgtttgaaatcatgggagagtggatcatgaaaatgaaacattaatctgataattgttacccttttaaaggggaaataaacctttcagggaaataataatatctgataattttgtcctagggctttataatatagtgacttaccattgttatgtttttatgttatgttttcaatccgtaagttcttcaaataactagaaaaacagcaaccactatgttgatttaaatatttcagtattgtgaagtaaaagaattagaaatgcaatggtaattaatagttgtgtgttttaatgtatcatatgcatgtttataattagtgtgctaagattatatatgcttgttcatttaactaatttctaagggagaagttcagatacaaactgtgctttgatgaaaataaaataaaagtgaatgttaggaatctttaatgctatttataatgcatgttggcactttactgtataggaaacatatctggacctaaaatggaacaggaccgagtaatttaatgctaaatttttcattttacatataattcattgaaaaatacatgtatgaacaaagttcaacctgaacactgaatgatctgattgtataacttgcttctgggcatctagattcatgaagctgattccctaataaaggtaagtcattctggaataagtgtatccccttctagtaatttctaaacaacaaattgcatttgcaatatattgtcatgggttataactttagtctgtgaaaacaataccatgatactttttaaaaaaaaatttagaaaataaagtggaacaaaaaagcagaaaaccaatggcagcactaacagtgaaaaagtcgatctgctctaagtgctgcctcatcacccttgcctattaggcaaattatttttattgatgcttatagaagtaaactaatattcattttatttggacatcttatatctaatacccaattttctttcatcattaaaactttaaaatcctacaaatatttactttaatagaaaatatactgtgaaattagacatgatagactctggggaagcatttatttgattaggaaaggttagttcaagctgttctttatgaaggaatattaataaattcagaagatgatatatttacgactaatatattttatatttttaccaagtatgtgaagtcaatttataaatcacagaaaattatcaagattaacaccatttacaactattgtatatattaagtttttatgtgctatatttgacaactttagatatttactataaattaaatatcaagttcattctgaatagatgtgtacaaataaagtgattgtaaatttattgaataaagtggaataaagtagtagtagtatttagaataatatactgaattaaaaaatgatttcttccaacattcatagtagaaagcattattaatatgataaatttggccgggcacagtggctcacacctgtaatcccagcactttgggaagccgaggcgggcagatcacgaggtcaggagatcgagaccatcctggctaacatggtgaaaccctgtctgtactaaaaatacaaaaaaaattagccgggcatagtggcgggcgcctgtagtctcagctactcgggaggctgaggcaggagaatgtgtgaacttgggaggcgaagcttgcattgagccgagatcgtgccactgtacttcagcctgggcgacagagcaagactccatctcaaaaaaaaaaaaaaaaaagataaattaagctaaattcttcttgacatattagatgatttgcaaaaggatgccaaattttggtggtaatgacttttattcttttacttttcaaaaaatgtaggtaaaccccctgtgcaaccatgatcatgcttcaagtacttagatcgtttttcttttgaattaactcttgtatattcaacagaacacttaattgttttcttttttttgttattattatactttaagttctagagtacatgtgtacaacatgcaggtttgttacatatgtatacatatgccatgttggtgtgctgcacccattaactcatcatttccattaggtataactcctaatgctatctctccccactcaccccaccccatgacaggccccagtgtgtgatgttccccttcctgtgtccaagtgttctcattgttcaattctcacctatgagtgagaacatgcagtgtttggtttttttgtccttgcgatagtttgctgagaatgatggtttccagcttcatctaagtccctatgaaggatatgaactcatccttttttatgcctgcatagtattccatggcatatatgtgccacattttcttaatccagcctatcattgatggacatttgggttggttccaagtctttgctattgtgaatagtgctgcaataaacatacgtgtgcacatcttcttatagcagcacgatttataatcctttgggtgtatacccagtaatgggatggctgggtgaaatggtatttcttgttctagatccttgaggaatcgccacactgtcttccacaatggttgaactagtttacagtcccaccaaaagtgtaaaagtgttcctattcttccacatcctctccagcacctgttgtttcctgactttttaatgatcgccattctaactggtgtaagatggtatctcattgtggttttgatttgcatttctctgatggccagtgatgatgagcattttttgatgtgtctgttggctgcataaatgtcttcttttgagaagcgtctgttcatatccttcgcccacttgttgatggggttgttttgtttttttcttgtaaatttgtttgagttcttcatagattctggatactagctttttttcagatgagtagattgcaaaaattttctcccattctgtaggttgcctgttcactccgatggtagtttcttttgctgtgcagaagctttttagtttagttagatcctataactaaactattttagagttgatcaacaatttctgtatatgcaaataatttaagtgtctatactaatgtaagaatatccatgacaatattttttatcttattgagaaatatatatcaccattttattaaagatttaagctttcttagatgatttcatctaagaaataatacaactaagaaacaattaattagattagatctcatctaatatagtttagttataaacatttgcatatctatattaaatactttccgtgttttcagcttttttgtatttaatgtaaaacccacatattgataacttgtttaaaatgcataaaatcaacgcctttgatttgcctatttaataaataaaattgaactctcagttcattttaattaaaacatttattttatgtttaattttctacactcagtgctgtgttatacataaaaataaataccactgcctgttcattttggaaccaaagaagggttgtatgtaaattaataagaattagacattgtcatttctctcaggagctcaggggcaacttaaagatattctcagttatttcataactatcatttaaattttctttttaaaagtttttgtttatatttggcacataattttacatgtttatagggtacagtgtgttgtttcaatacatgtatacattgcatgatgatcaaatcagtgtagttttgatctatccctcaatgtctatccctcaatccttgatcatttctccgtggtggtaactttcaagattttttgtctagctaccttgaaatatgcaatacattgctattagctaaagttaccctattatgtgatagaacatcagaacttattcttcctctctaactgtaactttgataaaccaacctctaccctaccactcccaccttctcccttacctcttcagcctctacctaaacactattcaactctccacttctatgagatcaacttttagaaatttcatctattagtgaaatcttgcagtatttgcctttccgtacctggcttatttcacttgacattttatcctctagatttatctgtgttgccacaaatgacaggatttccttctggttttaatagccgaatagcattccagtgtgtaaataccacattttctttatccattcattggttgatggatgcttaaattgcttccatctcttgactgttgtgaccagtgctgcaataaacatgagaatgcagttatctcttcagcatactgatttcattttctttggataaatacccagtaatgaaattgctgaatcatatagtagttccatgtttaattttttgaggaacttctatactatttttctataatggatgtactattttatattctaactaacagtgtataagagttcttctttctccacacccttgccaacatttgttatcttttgtatttttgataatagctattctaactgggataaggtgatatcttattatggtttttatttgcatttcttttgatgatgagtgttgttaagcgtttttatcctatatctactggtcatttgcatgtcttcttttgataaatgtctattcatgccctttgcccatttttggatgggatttcttttttgctattgaattgtgtgagttcttcatatattctggatgttaaccccttgtcagatgcatagtttgcaaatattgtctctcattatgtaggctgtaacttcagtatgttgactgtttgctttgcagaagtttcttagttttacataatttcatctgcccatttttcttttattgcctgtgcttttcaggatctatctgaaaaattcttcttgaatcaattttgtgaagtgtttcccctatgcttttttgtaatagttttgtagttacaggtcttatatttgagtctttaatccattttgagttcatttttgtatatgtgagatagggtccaatttcattcttctacgtgtggatatctagttttcctgggaccaattttctttaattgaatggactgtcctttctccaatgtgtgttctcagcacctttgtaaaaagacagtttactgagatgcatggatttgtttctggcttctctattctgttctgttggtctttgtgtctgtttttatgtcagtaccatgctgttttggttactgtgggtttgtggtatattttgaaatcaggtaattggatacctccatccttgtttttttgctcaagattcctttgactattctgggtcttttgtggttccatacaactttaggattgctttttctattttttgaatgaatgccattggtgttttgataaagattgcattgaaattatatatcaccttggataatatggacattttaataatattaagtcttccaatctataaatatgtaatatctttttatttgtgtctgcttcattttttcattagcattttttcattactgttttatagtttttgttgtagtgatcctttacccccttgattgactttattcttagggggatatttttggctattataaatggggtaactttcttgatttcttttttacatagtttgctattgccttagaaaaaatgcttctagattttctgtgtttattttgtaccctgcaactttactgatttcacttactagttctaacagttttgtggtggtatttttagtattttctacacatataattatgtcatctgcaaacagggacaatttaagttcctttttaaaatttttttaaactatactttaagttctgggatacatatgcagaacgtgcagatttgtaacataggtatacatgtaccatggtgggttgctgcacccatcaacctgtcatctacattaggtgcttctcctaatgctatcccttccctagcccccgagcccccgacagaccctggtgtgtggtgttcccctccctgtgtccatgtgttctcattgttcaactcccacttatttgtgagaacatgtggtgtttggttttcttttcttgtgttagtttgctgagaatgatggtttccagcttcatccatgtccctgcaaagggcatgaactcatccttttttatgtctgcatagtattccatggtgtatatgtgccacattttctttatcaggtctatcattgatgggcatttgggttggttctaagtctttgctattgtgaacagtgtctcaataaacatatgtgtgcatgtgtctttatagtagaatgatttataatcttttgggtatatatctagtaatgggattgctgggtcaaatggtatttttggttccagatccttgaggaatcgccacactgtcttccacaatggttgaagtaatttacagtcccaccaatagtgtaaaagtgttcctatttctccacatcctttctagcatctgttgtttcctgacctttaatgatcaccattctaactggcatgagatggtatcttattgtggttttgatttgcatttctctgatgaccagtgataatgagctttttttcatatgtttgttgacagcataaaggtcttcttttgagaagtgtctgttcatatccttcgcccacttttttgatagaattgtttgttttattcttgtaaatttgtttaagatctttatagattatggagattagccctttgccagatggatagattgcaaaaatgtttacccattctgtaggttgcctgttcactctgttgatagtttcttttgctgtgtagaagctctttaattagatcccatttgtcaattttggcttttgttgccattgcttttggtgttttagtcatgaaatctttgcccatgcctatgtcctgaatggtattgcctagggtttcttctagggtttttatggttttaggtcttatgtttaagtctgtactccatcttgagttaattttttataaggtgtgagggaagggtccagtttcagttttctgcatatggttagccagttttcccaacaccatttattaaatagggaacccttaacacagacaaatggaaaatcattccatgctcatggataggaagaatcaatattgtgaaaatggccaaactgcccaaagtaatttatagaatcatgctatccccatcaagctaccattgactttcttcacggaattagaaaaaactactttaaatttcatgtggcaccaaaaaagagcccgcatagccaagacaatcctaagcaaaaagaacaaagctggaggcatcatgccacttgacttcaaactatactacaagtttacagtaagtaaaacagcatggcactggtaccaaaacagatatatagaccaatggaacagaacagaggcctcagaaataacatgacacatctacaaccatatgaacttcctttttttttttttttccaatttgaatgtcatttatttctttctctggccaaattgctgtggctaagactcccaatagtatgttaaccaaaagtggtgaaagtgggcacctttgtcttgttccagatcttagaggaaaaactataaacttttccctattcagtatgttattagctgtgggtttatcatataaggcccttatgttttgaagtatggtatttctatgcctaattcattgagaatttttattatgaggggatgttgaattttgatgtttgatttttctgaatgtattgtaacacatgtatgattcttctgtccttgattttgttaatgtgatttataaagtttatttctttgtgtatgatgaaccatcctttcatccctgggatgaatcccacttaatcgtggagtatattctttataatatattgtcgattctggtttgccagtattttgttgaggatttttgcatttatgtttattagtgatactggcctgtagtttgttttgttgttgtgttcttgtctggttttggtatcagggtagtgatgaccttgtagaatgagtttgaaaatattccctccttttaaagtttttgcgtgagtttgagaagaattggtattagttcttttttttaaatgtttgttagaattcaaacctgaagccattaggtcctgggcttgtctttgataggagagtctttcagactgccccaatcttgttatttgttattaattggctcagatcttccattacttcatgatttgatcttggtagcagttaggcaagagaaaggttgtatttgtccaggaatttacccatttcttctaaattttccaattcgttggtatatagttgttcataagtatctattataattatgtgtattggttatagtaccttctttttcatctctgattttatttagttgagtttttactctttgtttttagtctagctaaaattgtatctgttcgtattttcaaaaaataacactgttcatcggtctcttatacgtttttatttctatctcatttatttctgctctgatatttgttatttcttcccttctactaattttgggcgtactttgttctttttcctttgtcttgagctataacattaggttgtttatttgaaacctttcttcttttttgatgtagaattatgttgctctaaaattttctcatagaactatttttgctgtatctcataggttttggtatgttgtgtttccattttcattggtctcaaagaatttttacactaaaaataattcttcattgattcattcatgttgtcaaatgtctacgtattagagtttctaacattccttttgtcatttattcctggttttattctactgtcgtgagaaaatataatggatatgattttagctttttaaaaaaattgttaagacttgttctgtgacctaaagtatggtctatactggagaatgttccatgtgctgttaagaagaatgtatgttttatagctgatggattgaatattctgtaaatgtctgttaagtcaatttggaaaacagcacagtttaactgcagtgtttctttgttgattttctacctgaatgatctttacattgctgaaaatggggagttgacatctcctactattattatattgcaaccaatctctccctttaggtctatgtgtatttgctgtatatatttgggtgctctggtgtaggatgcatacatgtttacaattgctatattttcttgctgtatggatgcctttattattatataatggcttaagtttgatattgttgtcattcctctcttaaattttatctgaaacacatatagctacttacactctttttttagtttcagtttgtgtggaatatctttttgtgtcacttcagtttctatctttgtgcatctttaaaggtgaagtagatttcttgcaggcatcatttatttgcacctttttaaaaaatgttatatagtcactctgtcttttaattggacaatttaattcatttatattcaaagttattgttgataggtaagggtttattactgatatatttttactcattttctgttgttctttttttgatccttactatctttgtggttaaatgattatctttattagcacatcttgattctgtattatttttaatgcatctattataagtttttgctctgtggttatcatgaagcttacaaaaaaattatatagttataacaggtcattttaagctgataccatcttaactttaattgcaaagagaagaaactgaaacgcaatctacagttcaaacaccatccctccacacttttactttttgatgtttcaatttacataattttatattatatatctcttaaacaattatggtagctattataattaataatttttgttttagtcttcatactaatgatagtagtggtttacaggccacaattacagtattggtgtattcttaatttgtatgcttttaccacagagttttatactttcagatgttgttttgatacatgttagaatgttttcctttcaaatggaaggactccttttagcatttattcaaagacttgtctgttagttatgtatttccttagcttttgtttttctggtaaaatcattccccttcatgtttgaaggatagcttttctgggtataatattctttgttgaaaggtttttttgtgtgtgtgttttgttctagcacttctaaaatattatcccagtctttcttggaaggtagggtttctgctgaaaaatctgctggaagctctattggggctctgttgtatttggtatacttcttttctcttgctgctttcagtattctttgtcttcaatttttaataatttaattatgatgtgccttggtgaattcctctttggattgaatttaattgttgacttctgagctttctatacctggatgttgttgttattctccatatttggaaagttttcagccattattgtcttaaataatctttctaggctgtttttttcttttgtctccttcagtaatagaaaggtttattccctttatggtgtttcataatgcttgtaggcctttttcactctttcttggtctttcttttcctcttctcattggataaatttgtgtgttctgtcttcaagctcactgattctcttctcttttggtcaagtctgctgttgaagatttctggtgaggtttttaattcatttattgtatctataatataaaatttctattttttattgcttttgtcaaatttctgcttttattcctaggttgtttttcttaattttctatacatattttcttgtgattctctgcatttctttgagtattattctgaattctttgttagatatgttatagatctttaattcttctggctccattactggagctttgttaattcttttggtgaagtcatgttttcctgattttcccttgtgtcttcatattcattcctgtgcatttgctgaaatagccacctcttccatctattgcagttgttctttggtggttttagacttttaccaattgttaccagagtttaatcatgggcccgtttgttgcttcgaattctagggagaccttatagtgagcatcagaactaaaatatggcaccagaacttactcactgcccttctgctgtttcccatgctgaggatgacttattgcagtctgaagaaaacttaagcacacatcagaatttaattggtaaccttttaggttttgcaagttaggggattcttgacacaaatacttaggctttgtgaggaacccagccagggttttgggccttcacatatactaggctccctttagcaccaagataccaggcagcattctcagcatggcttcccaactgataggaaaacagagcagataccaagattttcatgcttgtcactgcaatcagtgtccccagtcttctttccaatttaccccacatcattgagccctgttggccctcccattgcttcctgtggaatgaaatcagtttggccccccatgaagattcccagactggtgaggagattaaacatccacctttatttcttcccaagaaactgtgagtctaaggaaattctctgagagtggtgttatgcctgcttgggagacgtgggcgtttaccagctgtggcttctgtcatttttgtggctcagggtatttttgtgcttcttttccaagttcttgtgaactcaaggtggcattcttgcctttgaatactttctaggtgtacttttgttgaggggagtaatgctgagggatcttctatcctgctctcttgctgatgtcactcctcttaattttcttttaagtattgttgaatacaaagtcttgttgcctactgatgtggtttgtctctgtgtccttacccaaatctcatgttcttgtaatccccaatgttggagattgggcctggtggcaggtgattggatcataggggaggtttctcatgaatggtttagcaatatctctcgatgctgttttcatgatagtgagtgggcgaattgtgagatctggttgtttaaaagtgtgtagcaccttccccctcctcttcctccttctgtgaccatgtaagatgtgcctgcttcctcttcaccttccaccattattgtaagtttcctgaggcctccccagaagcagaaaccactatacttcctgtacagcctgtagaaccctgagccaattaaacttttctttataaattacccagtctcagataattttttatagcaatgaaaaaacagactaatacatacctttaatttttctaattaaaggactaatactaatacctttcattagacctttaatgaattatagactaattctaattatagactaattctaatacatttaatttttctccatagaattattactaattgttattactttgctatagaatatccagataaagtgtttaatttcctttaatttttttttgttttttttgagacggagtcttgctctgtctccaggctggagtgcagtggtgtgatctcagctcactgcaacctccacctcccaggttcaagcgatcctcctgcctaaacctcccaagtagctgggactacaggcatgcatcgccacgcccagctaatttttgtatttttagtagagagggggtttcaccatgttagccaggatggtcttgttctcttgacctcatgatctgcctgcttcggcctcccaaagtgctgggattacagatgtgagccaccgcacccagccagtgctaaatttaatacattgaaggagagattcatttctgacagaacatggaacttaaaatgaatatgagtcagcctttcttactacatattgtagattgatctcttagtgttttgatcgacagctagtatctcagtcgtaccatagatcagttctcatttctgatgccactagtgtcacaaaaattgatttgccattactctgttacctctgatctttgaagtggtagggtattaaacttttctattggtgagaaacataattttggcacagttatgtttcaaatatatgttattgattgcaaagagaatgaatctttacacaatgctaaacaaacaaatacacataccaggtagatagtgactcagtgatatcagcattttacatactaaattattgcttgtagtctcagaaaatagtatttaatccctaaagtatacctttaaaattagaaaagatagtatggcaaatttagtaacttttaataagggctcaatataatctgttgctttagaattccatcactgtgcagaaaattgaccttattttgtgcatgtttcatttttcaaattgattttctgtattttacctctgtaattactacatatgtttcgaattttgtcttcagtcatttcagctaattgaatgtaaaatttatatgatggttatattgaaaatgatttaaaattattggttggtgaaattgctgttatattggtattgatatacaagcaataattaccttactttgtagagtaattacaaggatgatactcctctacttatagttgtgggagtttgattcatattatattttttatttgttgcgaattttattttcaggtttatgcatttattctgtgtgatttttggcatcctggaaacctgtgcccactatgatattttttaaataccttaaaaaattcttcactacataatctgcaagactgaagttctagtgtctttgatttattcttcagttgtttgcaatgtggttggaatttatggccccaaaccataatgtggaaatgagaaacaacactggaatctacattcaagcttgggccctttgctcttttctcagaggcttatccaagcacacagcgagtttattatcccttttcatcttgatgggacagcttaaattgactaattcccagatgcgtacaaatataagtaaggggaaaatgttacttaaatacttcgatttattttttttttgtggttaaaataaaaacaactgctgctatcaagagaagctaggtatatgtttctttaacttttgtgtgcataagaatcacctggagagatggttcgacacagatttctaagtataacagtcagagattttgattccgtacattgagcagttgggtgctttagaattttccttttggattagctacaagttgctgatgctacctgtacaaggaccatataatgagtagccctgtgatggatgataagcaatcagaggtatcttcctaatgtttaaaactttgaggaaaatgggtacattcattaagtaggcacacaaaatatcttccacatatttggatgttaatgataaagagaacttctagggtgcaaatctggtggtaactatgctgaacatatattttttcacagacattttacattagaataatcctgtgagattcttaattaccaaaactcattggacttcaaatggaagttgcatttattaatgattagttatcaagaaaattatgtgaattactgattgttttatagagaagattgttttaaaaagcatgtttgatgtatacattaaattttttgctaaatgtccttggggttgtggggtattgtaaatcaaatttacattaagtggatgattaaaattaaaagctgatttttaatctgttttctaataattcatcacaaatttaactaattaaaagaaaacttgctttcaatttgtaccagttgataactttttattgatgtactaaatcttgtaaattggttataactatttgtgaataaaatctcataacatatcagaaaaatggactgtgggttccaataacagtggattatccagttgcaaattagcgttttaatgagaactaccagaaaaactggttaatattttttaaataaaaataaattttacaacacaatgaccatggtagggagcacaggagaggcccagatgctggatttatcttgcaggtaattgtcaatttgcacgtgaaaattaccaggctaagaagccggaagaagttttagcagtcttcaaatactatgatgttcagagtataccaagtaggagcttaactacccaagctttcaattgataccactaaagtgttacatcttggaattgagattgtaatgggaagacttgtaagatggctcccagtgacccacattttttgtcattccctccctttgagtatgagaggacctatggatgtgatgggatattataactgtgactagattcaattttgtgaccaagatgaagagattctgcagatgtattaaggtcccaaatcagctggattttgagttaattagaaaggagattatcttaggtgcacctgatttaataaactcttcaaggagtgactgagacattgcttgtgagagagacgctcttactggccttgaagtagtaagctgccatatcataatagggccctgtggcgaggcactgtgagtggcctttagactttgtgagcagctgtcaactgacagccaacaagaaaacagggacttcattcctacacctgaaaggattgaatttgtcaccaatcgtgtgagctcaaaagataattctaaactccagaaaggagcaaggcctggccaacaccttgattttggttttgtgagcccctgagctgatggcattgataaactgcccaaatgccttacccatagaaactgtgggaaccttaaatgggaaaatgaaaggttgcgattattctgtatagttcctttcatttctaaacattatgttttcaagttgtgttagtattatattctgaattgagtttgttagaattgattccatatgaggaatatgttgtttattcatcaagaaggaatttatatacttaggaaaaggcctagaaatatgttcaccaaactctcaaaaattgatattatagttacattacatacctatgttagagtataggataaagaggcgatggttgggagatagagaagggaatgctaacattttgtttatgcacttctatactttagattttttgtatagaaggagcattgtttactctttactgtttttacacctgaatatcaactttaagacagcaatacaacacatcagggacaaaattgtttccatatatagtcttaggttgtctattaccaactatggcctaatctagacttgatgacacattaggaaatctatcttgtattcaacgcaaagatagaacccttcatatttccactcctattccatccctacccctccgtcagtgccccccaactattctcatggttatcaaattttagtatctggatgttcatcctcaacttgttatttgcttcattatgcttaattagaatctcattacagttggttgggtcaactaaaatttttctctcataagagacaggatcaactcccaaattccagtactattttgaataggagtggtgggagtgggcatccttttctggctctggttctcaaagggaatgcttccagcttttgcccattcaatatgatgttgactatggttttgccataggtggttcttattatttcgattcatatcttttcactcagttctcccttaggagtatttgggttatccattatcttggaatataattctatatcattttcctatctgaccttcgtatattaccacttgtgctaacaatttctctctggggttactttttattatattttattttttaaaatctttcattttaggtttaggggtatatgtacatgtttgttatataggtaaattgtgtgttatggagggttggtaatacagattatttaatcacccaggtaataagcatagtaccccatttgtagttttttgatccccaccttcctcccaccctccctgctcaactaggccctagtgtctatctttcccttctttgagtccatatgtacttaatgtttatctcccatttataagtgagaacctgtggtatttggttttctcttctgtgttagtttgcttaggataatggcctctagttccatccatgttgctgcaaaggacttgatctccttcttttttatggctacatagaattccatggtatatatatgtatctatatacctcattttatttatccagtctaccgtttatgggcatttaggttgattacatgtatttactattgtgaatagtgctgagatgaatatacgagtgtatgtgtttttatggtagaacaattattttgggggagtatatactcaacaatgggattgctaggttaaatggttgttctattttaagttctttgataaattgccaaactgatttcaagaatggctgaactaatttatattatgaccaactgtgtatatagtatagtgtaaggaaggggcccagtttcactcttctgcctgtggctagccagttatcccagcatcatttattgaatagaaagtcctttctccattgcttctttttttttcttttcaatttgtaaagaagagatggttataggtgtgcagctttatttctgggttctctatcctgttgcattggtctgtgtgtctgttttgttccagtaccatgctgttttggttactgtagccttgtagtatagtttgaagttgggttatgtgttgcctgctgcttttttctttttgcttaggatagctttggcaatttgatgtcttttttggttccatatgacttttaaaatactttttaaaaaaaattctgtgaagattgtccactggtagtttgctaggaatagcattgaatctataaattgctataaggtgttatggctttttttttttttgaggcggagtctcactctgttgcccaagtgcagtggcatgatctcggctgactgcaacccctgcctcctgggttcaaccagttatcctatctcaccctcccaagtagctgggactacatgtgccaccaccatgactgcctaatttttatagttttagtagagagggggtttcaccatattcatcaggctggtctcgaactcctgacctcaggtgatccacccgcctcggcctcccaaggtatgaccattttaacaatattgattctccctatctatgagcatggaatgcttttccttttgcttgcatcatctctgatttctttgagcagggttttgtaacgcttgtagaaatctttcacctccctggttagctgtattcctgtgtttttgtggttgttttgtggttattgtgaatgggattatgttcttgatttggcactcagtttggacattgctggtgtatagaaatgttactgagttttatacattgattttgtgtcctgaaattttgctaaagtgttttttaatcaaatttaggagctattgagcaggaattatggatttctcaaggtatgaaatcatatagttgtgaagagagatggctttacctcctcttttcttgtttggatgcctttatttctttctcttgcctgagtgcccttgctaagacgcttccatcttttgcccattcaatatgatgttgactatggttttctcatagatggctcttattattttgatgtatgttgcttcaatgcccagtttgttgagggtttttaacatgaaggaattttgaattttcttgaaaaccgtttccgtgtctattgagatgaacatgtgttttttgttttagttttgtttatgtgatgaatcacatttattaatttgcctatgttgaaccaaccttgcattcaagggtaaagcccacttgatcagggtggattagctttttgatgtgctgttatttggtttgctagtattttattgaggacttttgtgtctatgttcatcaaggttattggcctgaagtcttctctttttgttgtgtctcttccagcatttcatgttaagatgatgctagcctcttggaatgaattaggttagaattccttctcctcagttttttggaacaatttctgtaggaatggtaccagctgtggttcatatatctggtagaattcagttgtgagtcaatctggtccaggactttttctgcttgttaggctttttactactcatttatttttgatatttattattgatctcttcagggtttcagtttcttcctggttcaatcttgagaatatatttttcaatggaatattatatatttcttatatcttttttagtttgcatctatagaagtattcataatagtctctgagggtttttttgtgtgtgtgtgtgtatttctatggggtcagtgataatgtcccctatgtcatttctgattgtgtttatttggatcttctctgtttttttctttattcatatagctagtagtctagcaatcttatttattccacaaaaacaaacttttcgttatgtgaccttttgtattttttttctcaatttcattcaattcagatctgattttttaaaatttcttttcttttgctagtttttgggttggtttgctgttgtttttccagttcctcaagctgttaggttaggttgtcaatttgaggtctttctaactttgtgatgtagctttcttcttaatgctgctttagctgtggccctgagattctggtatgttttgtctttgttctcactgttttcaaagaaattcttgatttctgccttaatttcattgtttacccaaatgtcatttaggaacaggttgtttaattttcatgtaattgtatggttttgagtgatcttcatggctatttttatagcgctgtggtctgagagtgtggttggtatgatttcagcttttttgaatttgctgagaattgtttcatggctgattgtgtgtttgattttacagtacatttcatgtgcagatgagaagaatgtatattctgttgtttttggggtgaagagttctgtagattatctgttaggtccatttggtcaagtgttgtattcagttcctggatatttttgttagttttctcccttgatgatctaatattggcagtggggtgttgaagtctctgactgttattgtgtggttatctaagtcttttgtaggtctctaaaaacttgttttatgaatccgtatactcctgtgttgggtgcatatatatttaggatagttaggtcttcttgttgaattgaattatatgcaattatgtaatgtgcttgtctttttgatcattcttggtctaatgtttgttttgtcttaaattagaatagcaacttctgatatttttaattttacatttacttggtagatttttcttcatttctttactttgagcctctaggtctccttgcctgtgagataggtctctttaagacagtactgtatagttgggtgtttattttttatccaacttgctgccactttatgccttttaattggggcatttacccagtttgcattcaagattaatgttgataagtgggtatttgattctgtcatcatgttgttagcttagtattatgcagactggattgtgtaagtgctttatggtgtgagtggactatgtacttagttgtgtttttgtggtagccagtaacagtgttttatttccctatttaggactttcttaaagacctcatgtaaggcaggtctagtgctactgaattctcttagtacttgcttgtctgaaaagaattttatttctccttcatttatgaggcttagtgtggctggatctgaaatttttggttggaatttcttttctttaagaatgctgaatatgagtcccccatcttttctggtttgaagggtttctgctgaaagtttcattgttagcctgacggggtttcctttgtaggtgacctgccccttctctctagctgcctttattttttctttcattatgaccctggaaaatctgataagtatgtaccttggggatggttgtcttgcatagtatcgtgcaggggttctctgtattttttgaacatgaatattggcctctctggggacatgagagaaatttttgtggactgtatcctcaaatatgttttccaggttgcttgctctccctctctctttctgccatgtcagtgtgttatagatttggtttcttcacataatctcacatttctctgaggttttgttcattcttttttatttgtttatatgtctgattgagttaattttgagaactagtctttgagctctcagattgtttccccagcttggtctgttctgctgtttatactttgtgattatattatggaattattgtattgtttttcaattctatcagattcgtttgtatctatcttaaaacggccatttcttcattcagctcctgtatctttttattgtatttcctggattctttggcttgggttttgactttctccaggattttgatgatcttcattcctgtgtatattttgtattctatgtctgtcatttcagcctggtgcagaaccattgctggggatctagtatgggcatttggaggtaagaagacactggctttttgtgttaccaaagtttttatgctgtttgtttctcatctttctgggctgatgttctttaatctttgaagttgctgtcctttgaacgaagccttttgcttttatcttctttgaagccctttggtgtttgattgtggtatagggtgcctttagtcttctggctttgattatggaagattccagggggccgggaagccccagctgtgtcttctggccccttgaggttatgaccctgacggctagaagtgctgaagcgttcctcataagctggccccaaaactttaaggagaatgctggctgaagcgcttcgtagggttgttggcagtggtatcagtgctcacctgtgcttgccagtcactgtggccttgcagtggagtgcttttgtgtcagtggggtggtgcactagtatgggtgaggtgctgacaggggcgggcacaccggtgtacactgtgctcacttgcgccagagaagaagcggcacagcaggggtgggctgctggtggacacgaggttctggaatctgtgcacgcagttgcacccaccgctgtgcggtgggctgcccacacatcagcgagggcgcagtgctggcaggggtgggcaaggcagcagagtgtgctcatgacagcagcggtggggcagtggggtgcacactcacatgcctgctgtaggaagagggttggcgaggtcggtcggcccttgcgcacacactgccaaagcagtgaggggaggctgcagtgagaagaggctgtgggtgggctggttttgtcggcagagtccggtctgctggacttctctgatggttaggcatggactgccagcgaagaagctatcatgaaggcatcagggaagcaccctggttaggcatttgatgctgcattgcaagcgggagtgatcaggctggggctccaggagaagctggcagcaggagaggctgctcagatagaaatggctctgaaacatgggcaggaccgccctgttcccaatccgactgtcacccaaatgcaaaagccacttagaggagcttggtgagccttgggggatagacatccctggccatgctccactgcagccattcccccgacaaaccttctgagctatgcccaggttggagtcctggcactggcatctctcaaagcagctctcgctgccagatcaagtggtttgtgggggtcctgaggtctcctgcaactaggattacgggggtctgtggcaagggtgggccactcatcacctgttaaactcaccccttccccagtattcactgggggccaggagtgggtcacagggctcaacagccccatgcaggatttccagattcctcccgcttcagtccagtatcttcatcctccttccgtccactctcagtgccttccctctgaaggtctgcttgaagtgtgctagtattcccagtgcctggctgtgtcaggtcagccatcttggctctttcctctgtttttttttgttgttgttgttttgtttttcttactttttgtctttctgataattctcctttttttttttttttgagacggagtcttgtgctttctcccaggctggagtgcagtggcgcaatctcagctcactgcaagctccgcctcctgggttcacgccattctcctgcctcagcctccccagtagctgggactacaggcgcccaccaccactcccagctaatttttgtatttttagtagagacggggtttcactgtgttagccaggatggtctcgatctcctgacctcatgatctgcccgcctcagcctcccaaagtgctgggatttataggcgtgagccaccgcgcccagcctctgataattctctttatctacctcacccaaaatatacttgtagtgaaaatatacaatttcccttattgacatatacattgaatagaaaaataaaacaaaacatgcatattatcttctgaaaaatatgtatccattttctatagctagataaatatttaatggaagaaacaatgcctcatatgtgtgggcagaagttaaaaaaggaaaaataaaagatatggtacttcttttctaataccagagtttgaagtgcttccattcttattctactttgttttggttagcaacttaaaatatgaattattgccatcagaataaatctgatttagtgaatttattttaagttgtatttgaaaaaatagcaatatttgttaaaaatttaacaataaaaaattaaattagttacttcctggtctttgataagtcctaaagcatgacatcattgttgaacttagaaaatctctgtgctgatgtaggtacttccaatcattaggtgggattctgccactatatcaataagatgtgtctggtacactgatatttgttgacgtcactgattcctagttctctcaggagtctctctgtggctttccaacattcccctgggagaaaacgcagctatcagtggacaacttttcccattttattctgagtttttaaactattttctgtccacttgaaaatttatgttactcatcacattgccttctcctactttaattatactatgtttggaagaaatgaatgaaaacttaaatttaaatcacataataatatctataggaagcatcttactgtcacatattttgaatgttcctagttgcaattagttttcacccccaatatttagcttctcagtgtcatgattttgtactctcctgcctaaaaagaaaatctacgttctttctttaaattttaaaattatatttatcctaatattttacataactaagaacacatgactgtaatcacttgaaaggtattgtgaaaatacgaatgttttaggtacaaactcagaggtgccagacaaaatgaaattaatcagtatctacttgtgttgagcagttaccagcacagatggtaggaaattagcttattctttgtctcaatatattaatgatgcaaaattacatgtatttcactttggacaaatatctgacagactagcaagcaatattttagaaacatgaccccttgattgataatggagcgaagcatttaataccttaagtctaacttaaatttaatacattctatatcattttagatgcctccatctaagctttttaaattgggacattacacaaagtgatcaaaatagagtttcagtgactttgtggagtatagaattagaattttgaattcttcattcataaacacaggggtgatttttaaagattatgtttggcacttaagtcttgatggttgtctcctgagtagcctctaatctctattcagaagatttatattgtactagattgtgttttgtttgtttgtttgtttttgacagagtctcgctctgtcacccaggctggagtgcagtggtgcgatctcagctcactgcaacttccgcctccctggttcaagtgattctcctgcctcagcctccccagtaggtgggactacagtcatgcgccaccatgcctggctaacttctgaatttttagtagagacgaggtttcaccatattggccaggctggtcttgaactcctgacctcatgatccgcctgcctcagcctccaaaaatgctgggattacaggcatgagccactgcgcctggcctagattgttaaatcaacaaatcaagccaacaggatgatttgaggatttatataaaacaactagaaaactgaacaacaataataatttttattttttaatgaaatatatcaataattgaatgttaaaaggtgtgatgtaaatgatcattgttgaaaagaaagagtgatcggtcaagggatttttgttgttgttgctatgggcttaagaaatgaagaatgtggaattaatgagaagttgagaattttctgaggggctgggtaagaaactacaagagatatagagaaatacagtatgtgaacagaaagtagtctttttttcctctggaagattaacatatagacaaaagaaaaccaatgaggaacccacaatcttgggaagaacagataacagagtatccacagggagctgtatcccagaaagggcacgagatgagaaatgcagacttcattttttcatctataaaatgagaatttttcattctctttagtctgactaatatgactttcatggagatattttaaaattgtaaatgatatgaaatataataatagataatactggcattatattagttataaagtaaaatcatatccacatataacttttcacatccttgtatgagtaggaatgggcagtactagctttggagccataatgtcctcattatttgaaaaaactgtcaaaatccactctcttcctaaataattggttaatatgatattaaaatgtaaaatgaagactactctttgaaaattacacgataagtacaccactttagtacttacttaaaattttgttctttatagattactagggtgttattcataagtgcaacattgagaaatttacatattttcccaagaatttgggaagaatataatgaatgtttttttcttgcttaaaaacactcacaaattaatttgcaacttattattgactataaagttattcgtatcgctctggcaaatgagtaaacccagttcatatctgaaatataaaacttttctttctaaataaagaacaagttttactatttttgaaacatcctatttatggcttatcactacaagttaatatgcacattgtggagtttatttttgttattcgtagggagaattttaggtattgtagccaccttctaaagatctgaaatgagttttagttgtgacatgtattgtctttaggtcctatttatattttcagtttaggtggaaatagttctttttgacacgtccactgcttactttttgttattatcctttgcttacttttatgcctccaaaagtttgttgctttataattgatttgcctttaattcactgtaatcttcattgcaatagaatgaagtaagcttgtcaggtgtgattcctagctctttttatatttaggaattcaatggcagtagcaacttgagaactgtcttttcagaaatctcagtacattcgcaactgcaatctcatacactcagtaaatatatgaacggaaacattttttacatttccatttgttttgttactattccaattgctatttattgtcagggtttattccgtcctgtaaactgccactcccaaccataggagaaggagccacgtttgcaaaatgcaattaaagtagccacttcctccagctacctggacacagtaattgtccacaccttgtccaagctggaccaataagattctctcagaatttggaattgggtctcatagatatcagtctctgcggtcacttgaattaagttattgtaaactcaagatgaaagagttcaaccttttttattagcttgtgtgtataggaaaaaaaacagagaatgccaaaccagcgagaagataagaggatgggggatagggagagggaatgatgcaaaaggtgaggggataagagagagggagagagaatgatgaagagggtgaggggctgagggagatgcagagagaatgatgaagagggtgaggggctgagggagatggtgagagaatggtggaacgggtgaggggatgaggcagagagaatgatgaagagggcgagggaatgagggagaaagagaatgagagagaaggagaagagaagagggagagggacggggatgaaggagagtgagatggaagatggtagaaaggatgagagaggaggaggaggagagacaagaagaggggagaggaaagagaggaagaaggaagcctggaaaaaggagaagaaaggaacaggagagatgaagggagggaatagagagaaataacagggagtagggaggaagaaagataaacgagagagagagattgactgtagtaaagagatgtatgaagagcagaatcaagacattaggtgtcttcagagaaacagaaagaagctgaagcttcatgcctctttttattccttgatgctagtgccagaatcttgacttcactctctgctcttggtttccttgagttccacccatattgtttatttattttgcatcactcattcaaccctaagaaacttaaccaagatataaattaaatcaaagcttactaataccataatttaaaaatcaaatggattgtttaggtttttgaacatttaaagccatttaatatcttgttttgctatagaaatcattaattctttagcatatttgaaaaatacatacatggccaggcacagtggctcacacttgtaatcccagcactttgggaggccaaggcaggtgaatcatgaggtcaagagatcaagaccatcctggccaacatggtgaaaccccatttctactaaaaatgcaaaaaattagctgggtgtggtgacgcacacctgaggcaggaggatcgcttgaacttgggaggcagaggttgcaatgagccaagactgcgccactgcactccagcctggccacagagtaagactccacacacacacacacacacacacacacacacacacacacacacacacacacaaaagcaagaaaaatgcacatgtttaaatgattttttgttttttttgtttttttcattttattatactttaagttttagagtacatgtgcacaacgtacaggtttgttacatatgtatacatgtgccatgttggtgtgctgcacccattaactcgttatctagcattaggtatatctcctaatgctatccctcccccctacccccaccccacaacagtccccagagtgtgatgttccccttcctgtgtccatgtgttctcattgttcagttcccacctatgagtgagaacatgtggtgtttggttttttgtccttgcaatagtttgctgagaatgatggtttccattttcatccatgtctctacaaaggacatgaactcatcattttttatggctgcatagtattccatggtatatatgtgccacattttcttactagtctgtcgttgttgcacatttaggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccctgaggaatcgccacaccgacttccacaatggttgaactagtttacagtctcaccaacagtgtaaaagtgttcctatttctccacatcctctccagcacctgttgtttcctgactttttaatgatcaccattctaactggtgtgagatggtatctcattgtggttttgatttgcatttttctgatggccagtgatgatgagcattttttcatgtgttttttggctgcataaatgtcttcttttgagaagtgtctgttcatatctttcgcccactttttgatggggttgtttgtttttttcttgtaaatttgtttgagttcattgtagattctggatatcagccctttgtcagatgagtaggttgtgaaaattttctcccattttgtaggttgcctgttcactctgatggtagtttcttttgctgtgcagaagctctttagtttaattagatcccatttgtcaattttggcttttattgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagagatccagtttcagctttctacatatggctagccagttttcccagcaccatttattaaatagggaatcctttccccattgcttgtttttgtgaggtttgtcaaagatccgacagttgtagatatgcggcattatttctgacgcctctgttctgctccattggtctatatctctgttttcgtaccagtaccatgctgttttggttactgtagccttgtagtatagtttgaagtcaggtagcgtgatgcctccagctttgttcttttggcttaggattgacttggcgatgcgggctcttttttggttccatatgaactttaaattagttttttccaattctgtgaagaaagtcattggtagcttgatggggatggcattgaatctataaattaccttgggcagtatggccattttcacagtattgattcttcctacccatgagcatggaatgttcttccatttctttgtgtcctcttgtatttccttgagcagtggtttgtagttctccttgaagaggtccttcacatcccttgtaagttggattcctaagtattttattctctttgaaacaattgtgaatgggaattcactcatgatttggctctctgtttgtctgttattggtgtataagaatgcttgtgatttttgtatattgattttgtatcctgagactttgctgaagttgcttatcagcttgaggagattttgggctgagacattggggttttctagatatacaatcatgtcatctgcaaacagggacaatttgactttctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatgatattggctgtggatttgtcatagatagctcttattattttgagatacatcccatcaatacctaatttattgagagtttttagcatgaagggttgttgaattttgtcaaaggccttttctgcatctattgagataatcatgtggtttttgttctttggttctgtttatatgctggattacatttattgatttgcgtatgttgaaccagccttgcatcccagggatgaagcccacttgatcatggtgaataagctttttgatgtgctgctggattcggtttgccagtattttattgaggatttttgcatcgatgttcatcaaggatattggtctaaaattctctttattgattgtgtctctgcccagctttggtatcaggatgatgctggcctcataaaatgagttagggaggattctctctttttctattgattggagtagtttcagaaggaatggtaccagctcttctttttatctctggtagaattcggctgtgaatccatctggtcctgggctttttttggttggtaagctattgattattgccacaatttcagatcctgttattggtctattcagagattcacttcttagtcttgggaggatgtatgtgtcgaggaatttatccatttcttctagattttctagtttatttttaatggaggtgtttatagtattctctgacggtagtttgtatttctgtgggatcagtggtgatatcccctttatcattttttattgcgtctatctgattcttctctcttttcttctttattagtcttgctagcggtctatcaattttgttgatctgttcaaaaaaccagctcctggattcattaattttttggagggctttttgtgtctctatttccttcagttctgctctgatcttagttatttcttgccttctcctagcttctgaatgtgtttgctcttgcttttctagttcttttaattgtgatgttagggtgtcaatttgggatctttcctgctttctcttgtgggcatttagtgctataaatttccctctacacactgctttgaatgtgtcctggagattctggtgtgttgtgtctttgttctcattggtttcaaagaacatctttatttctgccttcatttcattatttacccagttgtcattcaggagcaggtcgttcagattctatgtagttgagcggttttgagtgagtttcttaatcttgagttctaattagattgcactgtggtctgagagactgttataatttctgttcttttacatttgctgaggagtgctttacttccaactatgtggccagttttggagtaggtgttgtgtagtgctgaaaagaatgtatattctgttgatttggggtggagagttctgtagatgtctattaggtccacttggtgcagagctgagttcaattcctgggtatccttgttaactttctgtctcgtttatctgtctaatgttgacagtggggtgttaaagtctccgattattattgtgtgggagtataagtctctttgtaggtcactaaggacttgctttatgaatctgggtgctcctgtattgggtatatgtatatatttaggatagttagctcttcttgttgaattgatccctttaccattatgtgatggccttctttgtctcttttgatctttgttggtttaaagtctgttttatgagagactaggattgcaacccctgcctttttttgttttccatttgcttggtagatcttcctccatccttttattttgagcctatgtgtgtctctgcccgtgagatgggcttcctgaatacagcacactgatgggtcttgactctttatccagtttgccagtctgtgtcttttaattggagcatttagcccatttagatttaaagttaatgttgttatgtatgaatttgatcctgtcattatgatgttagctggttattttgctcgttagttgatgcagtttcttcctagccttgatggtctttacaatttggcatgtttttgcagtggctggtaccagttgttcctttccatgtttagtgcttctttcaggagctcttttaggtcaggcctggtggtgacaaaatctctcagcatttgcttgtctgtaaagtattttatttctccttcacttatgaagcttagtttggctggatatgagattctgggttgaaaattcttttctttaagaatgttgaatattggtccccactctcttctggcttgtagagtttctgccgagagatcagctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatctgaatgttggcctgccttgctagattggggaagttctcctggataatatcctgcagagtgttttccaacttggttgcatttctccccgtcactttcaggtacaccaatcagacatagatttggtcttttcacatagtcccatatttcttggaggctttgttcatttcttttcttttttctctaaacttcccttctcgcttcatttcatttatttcgtcttccatcactgataccctttcttccagttcattgcatcggctcctgaggcgtctgcattcgtcacgtagctctcgtgccttggttttcagatccatcaggtcctttaaggacttctctgcgttggttattctagttatccatttgtctaatttttttttcaaagcttttaacttctttgccattggtttgaatttcctcctgtagctcggagtagtttgatcgtctgaagccttcttctctcagcttgtcaaactcattctccatccagctttgttccgttgctggtgaggagctgcattcctttggaggaggagaggcactctgatttttagagtttccagtttttctgctctgtttttttcccatctttgtggttttatctacctttggtctttgatgatggtgacatactgatgggtttttggtgtggatgtcctttctgtttgttagttttccttctaacagacaggaccctcagctgcaggtctgttggagtttgctagaggtccactccagaccctgattgcctaggtaacagcagcggtggctgcagaacagcagatatgggtgaaccacagatgctgctgcctgatcgttcctctggaagttttggctcagaggagtacccagccgtgtaagttgtcagtccgcccctactggggggtgcctcccagttaggctactcgggggtcatggacccacttgaggaggcagtctgcccattctcagatctcaagctgcatgctgggagaactactactttcttccaagctcagttggaaatgcagaaatcacccgtcttctgcgtcactcacgctgggtgctgtagactggagctgttcctatttggccatcttggctcctccccccatgtttaaatgtttatcaaaaaataaataaagtttacctctgatctcaccatctggaagtagctttcactaatgttttagtacattttcttttactcttctgtgcatgccagtacatacacacacacacagacacataacacattcattctttatggacgctaatcaacagtatgtacagttttacattgtgttatttttatgtaacaaaatgaagtttcgaaggcatggttttattcagtattatcccacttaattaaccgttgttctatttataatcattctggatttttaatttacacagtgttaattgtagcttcattagtgctatgattttttatttcttcatttagtcaacaaatctttattaattactcactctgtaccaaacattttgacacaactaaccaggaagatgtgtgtcttgaggagattacagctttacagtgagaaagactagtaagcaatactttcattcaattcaggtcactcaattctttgagggaaagggggtaagcaactacttcctagggggtaactgggtcttgaactgagtctcaatatatgaataaatgagaggaggatacatgtgaagtagcaggaaataaattagaaaggcaggcaggactcagatcatggggagggagagagagaaggggagtgaaggcttacttgccattatataaggaatgggtatcactgaacattgcaaatgtgcatggtgttggggggaggggagtaagaacatagtagatttgcattttttaaatgattatataacagtagaagatttatttctcaggcataaaacttaaagtgggaaagttacttgaagtgagaaatctactggaagagtccacacaggaaatgagatctaatattacactactagaggagagagattaacttatggctatattgagaagatagtttatgatatttgacaactagttggctgtcagaaggtgaagggtaaggagagactcaaattgctctcagtcttctggcttgctattattttatgaggtgtagaatataagaggaggggcaagttcagtagaaagtgtggatttgggtgtgtttggcttgtgttccctgttgatcatccaggtagaggtgaccagttgtcagctagtgctgccatcacagaatatcacagactgggtggtataaacaacagaaatttattttctccattttaggatctggaagtctgagattagggtgccagcatgggcaggttctggtcagagtctttttcctgacttgcagtggtcactttttctctgtgttctcacatgcaggagagagtgcaagttatcattctacctttctcttcttataaggtaacagtcctgttggattagggccccactcttatgacctcatttaaccttaattatctcctacaaaccctagctccaaatacattcaaaatgtttagagcttcaacctatgaatgaatttgggagagtagggatatttcagtccataacagctagacatcagtcttgaacttagtgacacctaagaattggaagtatagttgggtatgcctcatcatgagaatggataggtacacccaatcgagcatccggagaaggaatggaaaagggtcaagaactgaagcatttatgttgttctcaggagaagagaagatagcaaaaaagactgaaaaggtagggtgaaggagctggaggacaagcaggaagcaggatgcctctgcatgtaaggaagcagataattttatctagagtggaagattcaaaagtattaaatgatatgtagaatatcatattctttttacctatctaaacaactattttacctatctaaacaagtcagatcccaatcttttgctcttgacagcatatggtattgggaatattcactcattcctcacctcttccttgttcctagtttctttttagctattccatctgccttgtttatcactgttctgtgttacattgcttgtagtgaacaatgtcagtaacgtaacattggactacttaacaatatagaaacattgctttgtgtctgcttttccatattcagtagattgatatttttaatgtttgatcatttttaaaaaatgatccctgactagagatagcatgagattagcagggcaaactgtcgaatggacaacatatacctaattaatgaaaatatgttatagatgagtcacacttcagacattaatccataatgggtctctatttggagttgtttgaatgacatgtgagatatataatccaaaagaaataagcttagaactgtttaagcatgacctttcctaggagaaataaaaaataagttaaaaagttattttcagaaggaaatatattaaagtcattcctagagttaagaaaagaatgttaggaaaatatttacaaaataaattgtataatatctataaatatcatgggggataaataaataggaactgggaatatatctccaggtattttcacagaacagcttaatgacaaagacatttcctaaggcttaaatgtagcattattttgaattgtaaaaagacaacaaattaaacagtatttgttgtaaaaatgtatctcatatattattacatattgcacatcaagaatatttttaaataaagtgaatattatatactcgcttttttggtaaatattgcctaagtaaaacatacaattttggcttttgctctcaaaaacaagccttgatgtgcacacagttagagctgcgactgtagagcactattgccaaaggaggatggtaaacttttcagtaatgctgaacctactagcgtgtgagggcatttagcatactgatagtgatatgaactaaaggaaatgttgacactgtcctaaataatattctttttatttttaaagttacttccttgaaggcaaaatcataacctgcataagctcatagtacattaaggcttattattttgcctttgctatattgctaagaaaataaatttggttatcctgataaatttattcttcacaaggccatgaatattattttttcccaatagcttataattttattatagcttgcaagttgattgttttcttttgttattggcttcagtatttccccaagcataaaattttagataagtattccacttgggggattattgtgccatcctcttctttctacttaaagatgcactttttaaaacggcaatgtatttgtccttctcttcttccaaatctcaaaaatactcagtgaattctaataaataatagattaagttttctgtgattattttagccagttcattagggaattggggtcttgcagaagtatataaattttttaattgtttaacttgactcacatttttattagaatttgtttatattttaatcaaggcttttcattctgctgcattttgtggggcataattatgttttcataaggacatatatgatacaacatatgaattaataactaaacaggagacttagacttacttccaaatcctttttgaggataaaaaaataatgggaaagagcatcacttctagctgtagaacagcaagcaaaaaaactagaaagtttgcagattcacaacttttcatggagtcatcagagaactaaggtcgtagggcaaccagctaacctgaaacttaggaggagacatgagcacttgttttcctggagcagatactgccagatagcagtaagaatttagctgaatttttaagtcgaattggtaaagccagttgtgcactagaaagataatatagcaaccctattgactgcagatatgaggggaatttgcactgcagtcttttctccatagacttcaatgtatactcaatatctataatatttatagatattatacaatttattttgtaaatcaaaaaaaaaaaaaaaagatcgtctacagccctctgaaagcatctcttctgatacaggcatagcataagaagtacaggaatcactccgagaaaggcaggaatcatcacctggatccttctccccttccccctacagaagaaaagccttaaactgctaagtgtaggacagctattgtctgaaaaacagtgtaaaaggaagacctaaagttgagagtggagcagatactgagaaaagaaatggctatccatgtattacccatcctcaacacaagagaatactagaggaatttgaagcctgtgatgccaggtaactttggtaacaacaaatcccaaacctagcttaactcctgagtagaatgattcaaaccgcagatctagcagaaggacagtcattctcatttaaagacataaacactatttactcattctttaatgtcctacgcaagatatttagttttaaacaaaatgtacaagacgtgtacaatggcaagaaaaaaatgggcacactgccaaaataaaaagaattttataaaagcaaagatatgacttacataataaaactgtgagacagaaaagttttaattactgtcattaatattttaaagactcaaatggaaaaagtgaacaatatacacatcacataggtaattttagcaggcagctggaaagcataagaaagagtcagatggaaatactagaactgaaaaacatagcaacaaaagtgaagaatgcatttgataggctcatcaatatggttggtacacctgaggacagaattattatacttgaaaacgggtaaattgagagctgaggtagaatagtgtatttgcaatcttctgggaagtagtcttaaatatgtgtacttgtaatcccagatggagaaacagagaacaggaccaaagaaatatttaaggaaataatggcaaataattctctgaaattaatgacaaagaaattaaggaggatttaatgagaaaaaaatcaatgagagacaccaaaacaaattgaagaagctcagagaacgatacacacataaacacatgtataaaaaggaacccatattcaaattgctaaacaccgaagttaaaaagaaaatttggaagacatcccaagaaaaagacatattatgtacagtggacttgttatcagaaacaaggcaagtcagaagacaaaagggtgacatcttgaaagtgatgaaagaaaacaactctcaactccgaattttataaccactgaaagttatcatgatgaaggagaaatgaagatgttgtttgacatataaaaatggggagaatttattgtcagcagagcttctatataagaaatattaaaggaggttctttagggatatggaatgtaataccagagttaaacttggttattgatatggtttggttctgtgtccccaccgaaatctcacatcaaattgtaattgccacatgtcaggggagggacctggttggcagttattggatcatgggtgcagatttcccccttgctgttctcatgatggtgagtgagttctcatgacatctggcttttaaaatttgtagcactcccaccttcacttgccctctctcctgctcttctgtggaaagatgtaccttgtttccccttcaccttctgccatgattataagtttcctgaggcctcctagtcatgcttcctgtcaagcctgtggaactgtgtgtcaattaaccctcttttcttcataaattacccagtctcagttagttctttacagcagtgtgaaaacagactagtatagctatacagaaagaagtgaagggcgctgaaaataaaatgaatgaaggtaaaaataaaacatgtttctcatatttttagttgctctagaagataactgaccacttattaaaaagtaatagcaatgcgatatttatttatcttacatgtaaaaataaaatatgtgacaaaatactacagatgttgtgtaggagaagtattgggatatagtgttacaacattcttataatacatattaaacaatataacatttgggagttgactaaagatatgtaacttaaactagggtaagtattagacacattttgaaaaattatgtattgtaagtgaataccagaggtaatatggtatcataaaatatatttaatcaaaaaaagagaagaagaggaaaaaaataaacaacatatggaacaagtagagaacagacagaaagatggtagatttttaatttaacagtgttaataattacattaaatgaaaatagtctaaacacattaatttaaaaactgaatgacagattgggtaacaagagcaagatccaaatatatactgtgtacaagaaacccacttaatgtgtatggatatatatagaaaagtaaaagaatagagaaagacagattatggaagcatcaaccaaaaaaactagaattgctatattaatatcattagactttaaataacatatattaacaaggttaaacatgaacattaaataatgacaaagaaatcaattttccaagaagacaccttcagtcccaaaaaactatttaaatatatatgtacttaacaacataaattcaaaatatataaggtgaaaatgaatagacttgaaaggataaatagataaatccataattatattggaaggctgtaacagtcctttctcactaattaataaaacaaccaaataggaaatgagtaagtataaagaagacctgagcaacacaataagcacgatcagccaatttgatctaatttatatttatataacagtctaagcaacaatgcagctaaagcaactcttcaaggaaaactttatagatttgatgcttatataatatcagaacagaaaaaaactaaaattcatgatctaatctaccatcctaagatactataaaagtaagtgcaaattaaatccaggacaagcagaaggaaaaactaataaatatagaagcagcaatcaaataaattggaaacagactaatcaagagaatgaatgaaattaaaagctggtatttgaaaaaaggcattaaaatataataaacctatttttgaaagatatacaacacgaactttcactaaaaatataggttatgtgagtagtcctgtttgtatttaaaaatcacttaatgaagaagcctgtaggctcagatagattaactagtgaagtctattaaccttttaagaaaaaaataatataaattctacccagtcacttcccgaaaggagaagtagcactttcgatttatctaatactgaaaccagccacagacatcaccaagaaaagaaattgccaaccaacacaccaatacctctcatgaatatagatacaagaatcttcaataaaattttaagaaaaatcatctagtagcatattaaaaggatattatattatgagaaaattgtatttatccagaaaatccaaaattgatttaacattagaaaatcaatgtaattaatcatattaataaagaagaaaattcatatgatgatctcataaatgcagaaaaagcatttgacaaaattcaacatctattcctgttaaacttctcaaaatactaaaaaataggaagataattcgttaaccttaaataagacacttattatagaaataactggcatcatatttattagtggaaagctcagtgcttttccactaagatcagaaacaaggtatatgaacctacatttcctttttttttttttttttttttacattgtccttgtggcatgcaaccttactaaaatcacgtatttgttttaggatttgttttatagattgttggggattttctacatagaaaccattactgtatgtaaatagatattgggtgcgaaagatacagtcacagaacaaacctataccattattattaattaattttcttaaaaaggtgcagaaaattcaatagagaaatgtattttcaatgaattgtgcagaaagcaattagagatctatatctaaaaaatgaacatagacccatgattcacaccttatataaaggttaaatcaaaatgtattataagtctgaatgtaaagcaacatgtaaaacttttgaagaaatacaatatttgtaacttggagttcaacaaattcttagatatgataccaaagtcatcatccataaaagaaaatataaatatatttaactttaagaatataaatttttgctcttgagaagacattattaagacaatgggaagcaaaccacagactgggagaacatattttcaagtcaattaattgacaaaggatttatattcagaatatataaagaactcatacaactcaataataattaaaaactatctaattaaaacaaatgaataaaaaattaacaggtacttcaccaaaaaaagacatatgaatggcaaataagcacatgaaaatatgctcaacctcattatctgttaggaaatggaaatttaaaacaaaatgagataccactacacacctattattataactttataaaaactgaaaggggccgagcgtggtggcttacgcctgtaatcccagcactttgggatgctgaggcggttggatcatgaggtcaggagttggagaccagcctggccaatatagtgaaaccccatctctactaaaaatacaaaaaattagccaggcatggtggcaggtgcctgtaatcccagctactcgggaggctgaggcaagagaatctcttgaacccggggggtggaggttgcagtgagctgagattgtgccattgcactccagctctggcgacagagcaggactccatctcaaaaaaacaagcaaacaaacaaacaaaaaaaaccctgagtgctggggagaacctggagtgactggagccctcagacattgctggagagaatgcaaatggctgtcatgacactttgggaaacggtttggtagtttcttataaagttaaacttactttatgactcagccatcacactacaaggtatatactcaagagaaatgaaaacttaggttcacacaaaatcttatacgtaaatattatagcagctttatttataatcaccaaaaattggaagcaattaacatgcattcaaccagtgaatgcataaacaaatggtggtataaccttaaaatggacactcagccctaaaaactaaatgaactattgatatacacacacagggtaacaaactacatttttccatttatatgacatattggaaaatatcatgtaaataaaatgttttgaacaaaattagagtcagtaggtgcagttttggtttcacttggctttctatttattattatttgtataaatttaaggcatacaagagcaattttgttacatggatatattgcataatggtaaagtctgagcttttagtataaccatcacttgaatagtgtacgtcgtactcattaaataatttctcatccttcactaccctgtcacactcccatcctttcaagcttttccactgtccattatccacactctgtgtccatttattaatgtacacattgtttagttccgacttataagtgagaaaatgtggtatttggctttctgtttctgagttatttcacttaagataatggcttctagttcatctgtgttgatacaaaagatatgatttcagtctttttatggctgaatagtagtccattgaaaaaatgctcaacaccgctaatcacagataactgcaagttaaaaccgtcgtgaggtatcatcttacaccagtcaaaatggctattattaaaaagtcaaaaaataacagaagttagcaaagataaggaggaaatggaatacttatacacgtttagtgggaatgtaaattagtacaatgtctatggaaaaaaatatgatgctgtctcagagaactaaaaatagaactaccatttgatcaagaaacccactactgggtatattcacttgtatatttatcacagcactattcacaatagtaaagatatggagtcaactaagtgtttatcaatgaatgattggataaagtaaatgtgaagtatatatacacacacacatagacacacttggatttcttattgctcatctcgtctcttatggtatgtgcgtttgtatgtttgtgtgatgcttttattagtaagcattttacattaaaatattatttgccatataaatgaatgcgaataacctgtagcttaattatttttatgtggtataagtatttattagaaatcaaatggacgttgaaatttagtatcatatagaactttaaattaaccccggaagtaagttatatttcctccacactcgttaatgtcactgcaagttgtttctccatcacagaatataaatgggagtatatagcaaatgtctagcatgctatgtacaataaataatgtatgattaattagtcattttttaagtggaaaattattttaaagtagtttgaactatgatttaatttttaaatacacttaaacagtatgttagattagcaaaggcagaaatattttcatcactttgttatttattgatgcctagaccaatgtttggaacatagtagacctctgattaatatttgttgaattatttattgaatacatttggaataataatacatcataactaaatataacaaaaccatttttctaaggtatactttaggaaaatctagaataaatatgaattttggggttgtagcattgttatattatgaatatggattgaacactcattaataggagagagaggaataaagaataaataatctttgagatgaagatatttccatgtctaatattgtaggtaacaaaaatgatagacttatatcttttagaaagagttacctggctttctattatgtactgcttttctgatgatttcattgctttagtatttttaacttgtttctaataagagctgattggttatttctccccttagtatatataaatgtagctattctaaataatcatttattaacacaaattaaatttttatttcatttattgatacagtttgccagcgattagtgtccgagttaagaaatactgttatagcaacagcaatttccctagaggacttcttaaatcataaagtgagagtatttcaaattatatttgcttcacttaaatgtatctgttctgaaaatggcaacattgatcccatgatatacctgatatattctaattgcctagaacgtaaaccacaaattctgcattgcagatactatcacagtaaatgctgcttaacttatgcaaaatttatagaatgatgacaaaacaaaagcttctgagaggataagtgtttcaccacaagcggtttctgtatctgactccatttctaaactgtaaatcagccttaaattatcattgagtcctatgatagacactagtaatggtaagaaaatatgccattttaagctatattcttattgacctgtatgtttatatgagtgtgaatatgtgtgtacctgtgtgtacatgtttatgtatgcacaccttttttacacgttattttttaactaaaatattttttctttactttactttactttacaccatcatgcattgttactttgacctctacaacctaacaaatatctgccctctaatccaatgggaaggaacaaaatcctgtaagagtgtaggaaacctgaggatggtctacaaggttggctgcccattggaaacacttgtggaattttaaagagatatcgatatctttgttccacccaaggaattctgattaaaaatttattgtatgtacattggatatctgtatttaaaaaaaatctccccaagtgatcctaatatgcagtaaaatctgaaaatccttcctctagaaaacaaaaataaaagtgcctaataaacaatgattactgtgtattctgaaaccagaaacaaccattttcttaaccttttatggtttaaaaaagtatggtaggaaagttattttaaaaggaattaaaggtgattttatgtgacatatgtttatttttttaatgcaatcttcattataatggttttgaattaaggtataacctgtttttcttgtggagtgtatgcaatagaaaatcacccaacttaagagtcagaaaacatgagtgtgtgtggtggttctgccacttcttaaatatattgccttggctgggttctcctataagacttactttcttattgcccatggtagtacaattgttatagcatttcaaaaattaaatggtgtgtttataataaaggctatatataacaaacccaaagctaacatgggtttcccatactgaacaggcaaaagttgaaagcattccctctaaacactggaactagacaaggatgcctcctttcaccattcttactcaacatagcactggaagtcctagccagagcacttaggcaacagaaagaaataaaggtatccaaactgggaaagaggaagtcaaattgtacctttttgcacatgacatgatattagatacagaaaaacataaagactcaaccaagaaactcttggaactgataaatgaattcagtaaagttgtaggatacaaaatcaacatataaaaatcattatcattcatatatatcaacaatgaattagctggaaaagaagtcaagaaagtaatcttttttataaaagccacagcaaaaaattacatacctaagattacattttaccaaggaggtgaaagatctctacaattaaaagtataaaacactggtgaaagaggacataaaaatattgtaagatgactaggcacagtggctcatgcctgtaacctcagcactttgggaagctgatgcaggaagactgcttgagcctgggagttcaagacccacaacatagcaagggacaactctacaaattttttttaaaattagtcaggcctggtgtcatgcacctgtagtctcagccactgaggtggcaggattgcttgaacccgggaggttgatactgcagtgagccatatttgtgccacctcactacagcctgataataagaaaagaaagaaaaaatagtaagacaacccacgctcatggattgaaagaattaatattgttacaatgaccatactacccaaagcaatctcaggttcagtgcaatccctattaaaatttcaatgacatttttcacagaattagaaaaaatattaacatttgaattgaaccacaaaacactttgaatggccaatgccaagcaaaaataacaaagtcagagatatcacattacctgaattcaaaatatatgacaaagggataagtaaccaagcagcatgatattggtataaaaacagacacatagaccaatagaacagaatagaaaactcagatataaattcatgcatttatagccaactgaattacaagaaaggtgccaagaatgtgcgctggggaatgggtacccttttcaataaaagctaggaaaactggatatatgcatgcaagacaacgtaagtagactcctgccacttgtcaaatacaaatatcaactcaaaatgtattaaatatttaaatgtaaggcctgaaaatataaaatcactagaagaaaacataggagtaatgcttcaagacatgagtccaggcaaagattttatgggtaggactatgaaagcataggcatcaaaacaaaaatcagcaaaagggacattataagctaaaaaccttctgtacagcaaaggaaaaaaccgagtcaagacacaacctgcagaataggagaaaatatttgcaaattattagtccaagaagggattaatatccagaatatataaggaactcaaacaactcaatatttcccaaacaaatgattctattaaaaatggacaaaaaaatctgagtagacatttctcaatagaagacatacagatggccaataggcatatgaataaatgttcagcatcactcatcatcaaggaaatgcaaatcaaaaccacaatgaggtatcacctaacctcagttagaatagctattctcaaaaagacaaataataacaaaggctgctgaggatgcagagaaaaatgaagttttatactccattggtgggaacatcaattagtacagccattatggaaaacagtatggaagttcctcaaaaaaactaaaaatagaactaccatatgatccagtaatcccactaatggatatttatccaaatgaaaataaatcagtagatcaaagagttatctttacctccatgcttattgcagcactattcacaatagtcaagatatagaatcaacgtaagtactcctcaacagataaatggatcaagaaaaatgtggtatgtatacacaatggaatattattcagccattaaaagaaggaaatcaggtcgtctgcagctacatgagtgaacctggaagaccttatgttaaattaaatgaatcaggcacaaaaagataagtactgcatgttctcactcaagtggaagctaaaaaaacaaaaatgagtttatagaaatagagagtagaattacagttgttagaagctgggatgggtagcagggaggagaggagagggagaagttacctaatggatgcagaattacaactagatgggaggaaaaagttctagtgttctgtagcactgtagggtgaatatacctaacaataatttattgtatatgttaaaaatactagaagagaggattttaaatgcctcctacaaaaagaaatgagaaatatttgaggtgatggatatgctaattaccctaatttggtcattacacattgtatacatgtatagggatattgtatgctccatatatatgtacaattattatgtgtcaactaaaaacaaaagaaaaaagtgtctataattattcaggtataattttacactgttatctgtagcttactctggcctcttatgttgacaaactgtgttttttaagttcactttactgaatgacatatttactgttaactcatttcatgtagtttttattaaataattattcaatgcctactacatatctgtcagacacttgataagtgttgaatgcacagtgtcacgtgagacatggttcctgtctccagtgagttattgtccaatgcagaagaaagatacacacacacatgcacatgtgtattttggaggatagggtgaactaaaagtccaggattgcataagtaaaatgtgaaaatgctcaaatcaagaaggtcattgtgagttctttaaagcccaaaccaaatgtgttcaaatctaagtcatctttctgatgtatcttaggcattgaagttttggtgcactgagtagaatacatcgtgattatgaaatgttttcattgggacgtagtataaattaattgataatggtaaagactttgaaatcatattgtcttggttcaattttttcccctcaacacatcagctgtatgattatggataggtttttaacctttgggtttcactgtcctcatatgtaaagtaagcaaatagtgctaatacttcttggacttgttatgagaatgaataggtaatacctacaaaatgttttgagtgttgtccttacacatagggattagacaatatccactattattttaaagttactttaatgatattgcttatttgggaagcagattttttttgccttttctatatcagaatggttagttgaaaatattttacttttaaaataattattgaactgggaaaatgatttcatcagcaagatacagaaaaaagttggcaaaggtaaaaatacttttatttttcatcaaaatattaatatattatttttctgatttatggctcagacctattcattattattccttagatgctcgaatcctccatacaatgtggtacttttaaagagaacatctgtttttgtacaaagtgttgctatgaaacttcagtaggaaaacatagcaaacacatatacaaagtttagtactgcagctaaggcatgggattatattggtttggtttgttcattaaaaaaaggaaacaattattagctaaaccacacatttcagatgaataaggataagaaattcagggattatattgttctttggtaaaaaatctttgttttatagatttcagtgccttgaaggctcataggaaatgtagcttcttttatgtctaaatgtgttttgttatagaaattactcaagctatcttaaatgaagacctcaattgaagtttttagactatattattttgcttgtattccacaataactgtgttattacttccaatctttgattctgagaaatctggcctttattttttagagagagaaaatctcttgagagttttgagattagtgtagaaatatgcaattttttattccttctaaatttcacgcttttatattagaagatgttctgtgaggtttttttctggacagatattaagacagaatcaatcaaaaccaacgtaaacacactgttaaattcacacacaagaaaagaggtgtgtcatcaattaatttacataaattatctagctggctttgaaacctattgacatgtgagaagttcagagttccttcagcatagggcattctgttaagaatatacatgtttaaacagacaaaagaatttatatagataccatagacattttctgtaatgatatgaagtataatttgtatttactttcttcaaatatgggaatctctaatgtctttcaaaattaccatgatgttgaagacaatgtttatagtgatctcatatacaagtatagattttactgctctagtgatatcatttacaagtatagattttactgctctttcttctttgtttctgtgcaatctgttacaccaaccaaaaataagattgaaccgagatatgatttttagtaaacttggtgcttagtaaatttatttagatacttagtaaattaactaaaattaatttaggtgtttagtatatttattgaatgaaatctagcctaatatttataactggaatgttttataattgatttataaaaatcacaagtgatgttctttttatacagtatctatgtctttatcaagtcatagagattatatacttagtataaagagcaacatcaagattttgatggctggaaagaacactagaggaggacccctgaatatccattttcacttaacttatctgagtctgttaccttgagcataaaacggaaacgatgacattaccccagtaattatagttttgtgtttttccccagtcaccttagaaatatgtgctaagtacctcattatgtgctgctcataattttaaatactgtactgaggatttgctccctactttcaaagaaataccttatagtcagtgggggaaaaaaaactagcagacttttactacaaggtaatatgttatgacattataatttggttttatttgttggtcgcagcttaaatatcacctcttcagaggaatttcctgatcacccagtctaaagcagccttccagacaatatcataatcttttttaaagtgcacagcactatctaaattttctttcttatttgttcattatttttctgtctcccctcaaataaaatgtcagtcttatggctgcagatactatgttattcttttcacttctttaccctagtccttatcattatgcatatatatatatatatatatatatatattaggttttcattaatatttattgaataaatgaatgaaaggaaacttaaaaatacttgtgccatggcagcatagataaagagactttattaatttaaataattttttttctactatgttccagagacatactgtttgccccggggaatactttgttaatcttagtctggcgggaaggcattgatcagctttataattgcaaacaattgtaagtgctatggagaaatagtgaagggtggcatatgactatgttgaagaataaggtatttccctaatatgggagattagaagccttttgaggaagtttcacttgagctgaaatttgaactgtttgaactaaccaagtaaaagcaatgagaacatcatatgcaaaggccctgtgatgatgacagcagtagtctttgaagaaagtgaaagaaaaccagtatggattaactgtaatgggtgagcacttggtagagtgggagagatataactgaaatgctggacacagaacttgtaagtcactgtgctggtccatattagtagttgatatcggaaagcaaaatgtatacaggagaaacagtgtaaataaagcaaaagagtaaaaaaaagttagggatgcatacagtgtttgtcctttgacataactgggttactctgaaatatcaacattttcaaaatctcttctgtcaacactactataaggacttttatatatatatatatatatatatatatatatatatatatatacacacatgtatacataaaaacatgtattgcaaatagaaataaggtctctatttaaaaatctaacagttatttgctaatcacttatttttatacatataggcattagagaaaaaataaatattcatcaaagtgaattaaaaacaagtttacagtataatcagtagagaataggtcacattaaatacaaaatgtataattaagtcaaaatattcattgaatgtctgacttgcataggaagagacacaaggtctagtactattttcaaaaaatcagctgagacataaaacatacatgtgacaagcatcataacaaacatgtgacctacacaaatataaaaggaaatagctgagtaagagctaggcttggccaggtgcagtggcttatgcctataaccccagcacattaagaggcccaggttggtagacgggggcaaaacccagtctctacaaaaaattcaaaaattagctgggtgtggtggtggtggcatgtgcctgtagtcccagctactcacaaggctgaggcagaatatcacttgaacccagaaggcagaggttgcagtgagcagagatggcaccactgcactccagcctgggtgacagagttagactctgtctcaaaaaaataaaaaataaaaaataaaaaaatataagatttgggcttagtaaatatagaaggctttgtaggggatcaagtttgaattgcattttgagaaaagaagatgatgaatattaataaacacgtgaagtgaatgggagagaggctagtaatcaaaggcatgaagcccaagccatagaagtaagaactaatgaaatgtgtgaaattaacagatattaattttatggaaagataaagctcaagagtagaaaccttgattaaaaagatacctcgtcaattatctgaaggataagggaagaaagagcatttcagatggaggcactccctgtgtgaaagcttggatcattcagtgtcagtcatgtagcaagatgatgttagcttggagatgtagctatggtagaggctgaccactactaaaggagctaggtcattataggcctggtcatcttgctatagagctgtagtctggtgcattgaaaaagtactgagtgaaacagaagggagctaggacatgattacagagggctgggagggagatgatgaatataaaggaaaagggaagtgaggagagaaactagatgttagaggtatttagtcaattcagtaggatttaatgatttattgcagacagaatgaaggggaaggagaatgaaggataattcttatgtctgtttagctaattgaacacttaaggggaaccctgggccaacaaggtttttctttttttaatttttatttttttagaagagatagtgaattaaatgttatttgcatttaatcctaggtaattgagatacacaggatgagatatctagagggtagatagtcaggtccagccttggtgttacccatttggaagccatagcatcgtaatggattagattttagctgggcctaggaggatgaggtgtgttattggtcagtaccagggaaaaacagagggcttctgagctgcatggtgacatgtccatggagtaaggagaagacaggtatcactgaactcagcatgtgctggaataatatgtgataaggatgaatcatggatcagtaaggtgaggcaaatttatagatggaagtaacagaataagaggtgctacactttttaattgaagcaacttttagaaaaggaagatgaaattacacaatgaatgaactgcttaaggatgaataattgggtagacattggaagacaggactttatttcagtcaagtcatgtgaattgtggttactgtggttggaagatataggagaggtacataatagctgtcatataagagacaaagaataagagtaacatggaaatgtatgctcaaatgagacagatcaataattgtattcatgatttactgacacgaaatgctctttattgcctgtatcccaggtcttaccttgtttccagttagctgtgatttcaaagaagatactcctttgtgacccttgcttcagtcatctttccatttctttcttttctctttgtttctgctaacctgctgaggaggctgacagctctggacgcaagtgtttttgcttcaggagtagatgggagaaaagcatgtcctgtagttataatgctgctttttcctaggcagggagaagcagcccctaaattctagagaaaaatactgccttagttcaatgtagcagttctgatattcctgtgagtttaagaaaaaacaaacaaacccttcctccgctcaccaaacgaagcaataacaaaccaacaaaccagaaaccttaaagcagaggaaatccagattgtacttactcttcttctcactcacaaagaaaaggattcaccacatttttactgtcatggcattattgccgttaaagtctttttctttctctgtctagtaagtcttttttttcctgttcaatacagtttttttttgcttgttcattttttttccgatctagtggagagaacattgcaggattatgaataagaccctgagctggatgtcgtggctcatgcctgtaattccagtgttttgggaggatgaggcaggaggatcacttgagaccaggagttggagaccagcctgggcaaaatagtgagaccccatctctaccaaaaataaaaaaataaaaataaaaaaagaagaagatgggcatggtcatacatgcctgtagtcctagctacttgggaggctgaagcaggaggattgctgtagccaaagagtttgaggtttcagggagccctgatcatgccaccgagtacagtctagatgacagagcaagactttaaaaaattaaaattgaaaaaaggaccctgataaccatttgtagatacaaacacatttcaagttgggtctggtgggccgttttcctttagggttcaccacttgtggtgccatgttgcaaagacacagtgctatttatcatgtagctatcttacagatcttttgtctaatacctaacaaaccactcttttagtcctccaggaaaaagttctgggcactttaagccccatgccttgttcagaattatccttgctatatgctgtggtctaaactgtgattctccaaaattcatttcatgaagccccaaagcatagtagcttagaatgtaaccatatttggatataagactttaaagatgtgactgctttactatgagctcaacagggtggggccctaattcaatgcgactggtgttcttataagaggaaaagacactgtggagaaaagaaagaagaaaaggaagattaaaagccatctgaggatacaggaagaaggtggccttctgcaagccaatgagagaggcctgagaagaaaccaaacctgctgacacctggatcttgaccttctagcttccaaaactgtgacaaaatatatttctgttgtttaggccacttagtctgtgggtttttttttttatgtctgtcatagaaaacgtaatatacagtactttctggtgagtaagtttttattttccctgagtgaatttttagtagcacatatcttttctgtgctgaaaatgtgagacctctgatgatttgatgagcccttctcttaccctaacttgcttttacacttgtaatattataccaaaactaagtgctttctattcttattttcttgttagtgtgatgtttcacttagttgcattattcattttgctagaaattttgaatacatttgctaaagctggaatgaaaatctcaataaatgaataaataatgatttagtgacatctgccgtgtgcttgttcactcgttgatctttaagagtgaaattttccaaaagagactgatcattaggggtttctgtagatcttaagtatgatgctttttaaaaccttttatcagaaacacgcttctttgattaacatgaatataatatagtgatgtagttaagagtatatggtctggagttaatgtgctatggtttaaatcctggctcagcctcttggaagctgggtaacaatgagtgagataatcaattaaattagagcctcattttcctcatctgtagaacaagagtaataatagttgtgttcaactcatagtactgtgatgaagattgaataagttaataaatacaacagcacctggttcatcgtaaatgctccctacatttgggctattgttatttttctaaattctattgcttgcttgtctgaacatcatcttgggttaatattgttactactggaactttattgtgatattaacttaaagcagatttctcacctttggctctattgacatttggggctggataattctttgttgtgagtgctctcctgtgtatgtagcatgtttagcatctgtggagtttaacagcgtctataaagtctacctaccagaccccggtagcacactgcctcctcacccaagttgtgacaactgaaagtgtctctagatgtattcatccattttcacattgctataaagaaatgctagaggctgggtaatttataaagaaaagaggtttaattggctcatgattcagcaggctgttcagggagcatagtagcttctacttctaggaaggcctcaggaaagttttaaccatggcagaaggcgaagggggagcaaacacttcacatggctagagcagcaggaagagagagattggagagttgctacacaattttaaaaaactagatctcatgctaactcactatcacaagaacagcactaggggatggtgttaaaacattggacctccatgatccagtcacctcccacggggtttaggtgggggcccacctccaacactgggtattacaattctgtatgagacttggtggggactctgaacaaaaccatatcaccagacattgccaaatgtactctgggggtaaaactacccccagttgagaatccctaaaaaactttgattaacaaataaaatactgtttgggaaaatatatctaaaatctgcttcttacatgagctcgatttattttgactgatagtcttgggattttgtaaggtagcttttctttaaaaatattattaaaggaggtcatctacagtgtaactcataatttctctcactgtgtcataaggccagaatatcttgatatgtctaattctctaaattagaatgtatagccatgaaaaacataattgacttaaaaactgatcaaatatgttttcatgaaaacatctagtagctgaaataaattatacctgccacttattagagataactcagatgttatcacaaatggaattgtaattacttacttatatttctcatggtgctatagagatttgtctaaattagaattgggagtaggagggagaaatttaaatattcatgaaagtgtgatgtcatatttcatgattaaaggtatggaaagattaagtatatggataatttttaaagtaccatagaggtatttttctagagaaatgagacacatcacagtcaagtacatgtggatgtatattatctttataaattaagatattacgtggaacttactatggttcaagaactcagtaagaattttttaaaaaaataagtatgcttgcataaattccaaagtataatgacatcttgtctctgtcatccctttgtagtccatcaaaatgattaatgcctgtcagttgccattcattactcttttgctgactggaagttgcagtgcctcatctgatacactgatacactgatcaatgtggaataggctgaaagtacattttgcgggtctgtggaatttgtcttaatacttactctaaagtatttaaatacttaaatagttaatatttattttattttacaataaatactgttttataattatatgtgtgtgtatgtatatatgatatataatttaaagaatatatatcactatataatgatatataaagatatatgaatatatggatataatggtatatatactattcattgtgatatatatatataatggtatatatatatttcactgtgatatgaaatatatataaatatattttaaatattatatatatatatatatgtatcactacagtgttaaagtcaagaagcatgggaagcaaacagatccagaattcagggaatacaccacatataataaatgatatctagctctctttctccactaaaaaatacgattattgtagtttaatagcctaatgggattttccacatacttaatagttaccacatcatgttttcatgctaaggacaggttttctataatcctttactggcaaggtgacaagctggaaaagaatgggttgtctattactgattatgtagtctctaagaaatctttttcttttgttgacaatttgaatgccatgtcttacagtttttgtcagtgtgagaattttttaaattacttattttatttttattttgttggatgctttttctgtttgaccaataccagcaagtccttccaaaatcacaatatagctaaacatatcttcctttctcaattgtattaaatgtttattatattattaattgggtgaatttttgtattaatatgttatttaaaatacaccatttaaaattagattcaatatttatgtcagttttactttctttctctttgtcctgattgttttatatagtcaacattgaaactgagaatagagagaaagagaaacaagggattttaaaggataatagtaataagcctttgtataatttttttcatacatgactttttaaaatttcataatagtgaggtgatgtggatgtaccttctaacatcatcacattttgacagtgaggaaagtgagactatgcatgggaaaaagtgaggcttagtaagtgaagcaataaagtggaaatggtactttgtctagcccctctgaccccagaccctgtgctctcatgctacatcacagtgtctgtggaataaacttttatcacttttgttgttgagaaaatgaacttgaggtttcttattatgatgtataatttcccctgggaaaatcgttgatagcttgataaagacagccaagagttttggagaatgattaaataccactcttcactttttttttcttttaacaaggctttgaggatctcttcttctgatgctgaaaaacagcagccaactcaaggggggaataatatgaaaatataaatacatattttaacatatttaagtatcagatgttgtggagtactcaaagagtgtttttgcccggttttaacatatgcacatctgtatttttctttataaaacaaatgtagtgaaatagtttaatgctgaatattttattacctttttctacacactcaccatcttcaaaatcaatcaaccttcacttcaggcatactgtatgtggtcttatactagaaaatacataaatatattgtttaaaggattaaaagaaattaaccacatgccatttgtttcacgaaccaaagctgagtagtttatgtctgttttatagcgcatacacaatacttgacctccccctcccaggacttagaacaatatgaactctgaaatagaaagtcttctcggaaactttgggaacattgtgtcagacggagagatagtgctcagataagagccagtggtagttgtaactctcagtaataatatccatcatatcatctcgtggatcagtggttgtcttagtggaaatcagaagataatgccaaagagacattaaatgttcagaatgtcctgcactgtagagtataacttgttaaatttcacttctgtttaaatctcaattactggaagaagcaggtggtgataattatcttactccttcttttttttttttttttttttttgagacggagtctcgctctgtcgcccaggccggactgcggactgcagtggcgcaatctcggctccctgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatcttactccttcttgaagtttaagctatttaacaattaattattaatcagggttagaatcaagttaaataatctacttcatttagatttttccttctaaaccgagtataaattcccattagtactactgttattaaatggaacaatgacattatgatctatagatactttcctttctagataaacatattgtaaattcactccagcatgtgagctatatgttctaagtaaacaatgtgattctcctatttagcaaaatatttcattcagtgtattgtcttatcctaactctgagctttccaatgtatatttagaaatgatattcctttgtgaaagactgtatttctcagtgtgcatacctgttagaaaaatcaaacatagggtgcaagaaaaagtggtgaatttttttttttacttgttcctgcagttatactcatactcctctgctcatgtaaacatttcagctccccaaattcaacctgactgcttgaaaatctttactaataatcattacctcttgaataaaatccagattcctaatccttcagactaacctccatgagagcagacactttgtggttgtgcttgtggctaatatcatcagtgcttgctattgtgcctgtcctacagtaggtaatcaggaaatatttgtgaaagaaaaaaatatcataaccaaggtactatgctatctgacttaagtgtactttcctgaggtcatcttacataactcatctccatacattctatgttttaatccaatgagactatttttcttgcaccttcaaatgaccccattatctccatgcatgaaacaccagttcaagtgtactctcttcctaaagtttttcttatcacctcatttagatttttttcttctcaaactgtcttagaattttgtgtttcttttactattttttttcatttttcattgaatcacagttactaaatgtatcctttttcaactccttgaggtgagtgagtataagagagaggagagtatcttaactcttctttcttcaacagtgctcagcataggaccctcaagtgtactggtgtccaatacatgttggtgtgctgtgttggtgttcaatatatgattgttgactgaatggacacttctttgttcactttactacagaattgacttttttttttttttttttttgagacggagtctcgctgtcttgcccaggctggagtgcagtggcacgatcttggctcactgcaagctccgcctcccgggttctcgccattcttctgcctcagcctccctagtagctgggactacaggcgcccgccaccatgcccggctaatttttttgtatttttagtagagagggggtttcaccatgttagccaggatggtcttgatctcctgacctcgtgatccacgaggccgcctcggtctcccaaagtgctgggatataggcatgagccaccgtgcctggccagaattgactattttttggttatcactttttcctttagataaatcttaaaaaacttcccacagctgatgtaatttgatagaaattcagttgaacttagttcttaaagatatctgacaaacaacttttgacttgaaatataataagaaagaacactgaacttggaggaagaatcttgagttccaaaactggatttctgtgaactggttgagtaaatttgacatcaaaatcaattcttcgcattaacatcgtatgcaaaagaatttaatatggtacatggcgatagctatacctcaataaagcctcctttcatccttttcctattattatttcccttcacttaacttttttttttctttttccttttccttcttgccctctcctttaaaaatcataaatttattgaatgacttttaacattttatgacctaaaacttttctggcctggattttatattaaatcagttcagcctgctttattagtttatttgatttcccatatacaaaaattgaaaaaaaaattctatttgctttttattgaaaaacaaaagactaactaaacaatagtgccttaagctcctatgatgaaatatatagagtatttttaaaaacatcattggttagcaatatctaggtatgttgctagcatctaccttccaaatccactttggaatggctttgttgcttagattttaaagaaacaaaatttaaagaaacttatagtttgaatctgggctgacagtgggtgaaaggccaggactgagcatcttttgtaaggtgagtcaatcttcttaattgtgaaatgccccttttatgcagatttttctttttctttcaagtgcatctgttctgtgttttaggtggtgtttaaacacttttaacagaatggatagattttcctattattttatctacaaataaacacctggttcttgatacttctctttctccttttatcaccttttgcctaaggaaatctaatttattcattttgcctgtattttatactcacaatattttcttttttgcttttaccttctgcatataacaaaacattattcttgcacagagctctttttttcttgcaaacacatttactcttaatattttatcttttgagtctatattatgctgatgggaagtttttcatataggattgtttcatttttatgatacaggttcacttctttctcttcattgccttgtttgtagttttttttccctgcagaatgttttgtatgctacctttctctttactttttccagaatactttctaaacaagcagattgtgaatttcaaataattcatttttatttttatgttatgaactgacattcttttcctctgctattattcagatgaggaagaaagataaaagtgataaaaggaacataaattctgccatagaagttaccgccaagtgaatacatattctagtatataggagttttactcatgaaatattttgcctttacttaagaaacctaagttaaataggaaaatgattattttcattttaaaaaaattaaggtataaattgtgtgtgcaagtatatgcacagtctccccaaattatatttttctgtgtaaatatttacaaaattgaatatccttcttttttaatgactcctatgcagacaggagggagggtacttcataattttggttcataacatcccttaaggaattcattctagtggccaaaagagcaacacctttgtaggagggaaacaggatcaatcaagttaacaaaattattgttataagtttcttcacaggaagctttatgaaataaaaattatattcataataaaataagaaattatgaattatgaactcatcttaaaatggtctttaaatgttctgtatgatgtcagtgggccacacaacttgttcagtgtctaattatgttgataaaataagatatgggactttttttttaggtgaaataatttccattgtaactttttgcatatgtatgacaaattattctctttacgcaaagttaattggaggtttgatcaagaatctaggctctgtctggttcaataaatcctacataattatttattcatattatttccctcataagtaggaatttttgtcctatcattgttattttgctatgttgcctgtgtagatacagctatcagtttgaagcagcagttctgtctatgagaagataaaataatatctttgatgggtttctccatgtcagggttccttcaccttcaggcatgttttccaacatgtagttcttttttttcttcttaattgaatcagtattgctcataaattacaattgagtgcagattgaaggaaatgcaatgtcttcttaggagagtgtgtcacctagtatttataatgtaatcacaatgttcatagaaatttaaacgtattctttcccctacaacatttacactttaacagagacaaaacaaatatataatcattaaaactgttaaaggtaagcaggtaattataagattgcactgaatttcagctataagaatgggagtgactaattggagaaagtatcctacagctataattttaggggagaaagccctgtggatagagaagagatgctgttctaggtaaataaaatggtctgagtagagccaaggaggttcactcttaaaagtataaggagctagtacagataaatttcaaaggcaagccagtatccagattcaaaaacatcttcttaaattatatggttttctcgccacagatttagattcattctcattagaaatattgcatttttaagtatggcttttagaggcttgtggcttaaccagagcaaaggcagtagggtatgatctaaaggtcattctgcaattttagcagagtataactgtctcctgggtcaagatttggctattctctcaagaaaaggaggttaaatgacatctaaatggtattgttaagtaaaccaataagaagttttatctttgtagttataattctgtgacaggcttttcttcatgtcagaattactgatccctcataaagacaaaagcttaggtaagaaaatgttttcatctgatttagttttattgcttagagctgtgcaatttttatatgcctatttaaaaagaaaaaaaggaaaaaactcagaaagttatttttttctgggtaaaagataattggaaagcatttcaaccaaaagtcaatataagtctgttgagtttgtcattctccagatatgccctcagtttatttttaaaaaatcttaagttgacaatgcattttatttggctataataatttaagtaatattagacatctagacttatcatattcatcatagaaaaattttggtagcatctttatatttttaatctaaagcaaaatattgatcagcctgtcctaggatgtagttaatacattagctgatcaatttaaatgccatgataacttcagactcatagatcaagtgctttttatagtactttggaaacccttgagtttttttattctttcttggacttgaattaattttcagtctttcttcttactgtacttaaagtttttgacagtagagccatcattaaatgaatgggagtttgacctaaacttatagctgatattgataacaactgcttaaattttagtgaaacagtgaaatgtgtcattgataaaaacatcatgacctaggttccctgagtatgttagtaactccaatttgttagagtttatatgtatcatggtgttccatgggtgatagagtgccaaaacaatacaaacatttacatatttatggacattttggaaacagtcaattacctacttgtaataaaatatttaatattagaaaaattgaagaataatataaattaatttattttagttttaggttgagtttctttgactcaagaatttctacttatgtttttcatttctcttactacctaaaactaaagaaaacattaagaaaaaggcaggaaaggaacctaattctttttttaaactttttatttttattttattttattttattttttgagatggagtcttgctctgtcgcccaggctggagtacagtggcgcaatcttggctcactgcaacttccgtctcctgggttcaagcgattctcctgcctcagcttcctgagtagctgggactacaggagtgtgccaccacacctggctaattttttgtatttttagtagagacggggtttcaccatgttagccaggatggtcttgatctactgaccttgttatctgcctgcctcggccccccaaagtggtgggcttataggtgcgagccaccacgcccggccctaaaccttttattttaaaacaattttagattggcaatatgagtataaccattcaaagaagcaaaaacaaaatgtactgtgagattcaaggcactgtcttattccctttttctcttctttttattcattaaatatttatgtagtactgactttaagtgctggggaaactaaggtgaatataatagccgttgccctggaaaatttcataatcgattgtggaatagagacacattaacagataacccaaatcaactgtattaaatgcaatagcggaacaaagagaagtaggatcacataatccagctctgcagcagaggtgagggtggagagcagcaacaaaagagagcaatggcaagggaattctttatatttttgcacatgtgaaatgtctgtatagaaatatttgactaagatttactcagcaattagaaattgttttttgtttgtgcctatgtaattgtatcattacgatttcagtatcatttagactttatggataatctacacactaaatgtttattagggaaggaaaagtacttttagaatatgcaacaattctggtgacactcaatacatttttgttaaatatattaatttatccgtttattcaactaatatttattgaacagctgcatagtgctagtcattgcacttgagtcccaggaagatattgttatggactgaatgtttatgaccttccaaaattctatgtaggctcctgcccccaatgttatagtatttggagataggacctttatgaaggtagttaatgttaaatgagattataagtgtgtggtcttgatctaataggagtggtgtgcttataagaagagacaccagagagctcatactctctctcaaccatgtgaggacataagaagttggctttctgtaagtcagaaagagagctcttaccagaacccaatcatactgccattctgatctcctccagactccagatctgtggcaaaacaaatttctgttgtaaaagccaccaagtctgtggtattttgttgtaacaacctgagctgattaaaacagccataaataataagtgtaatacataaataaggttaatataacaattgcattattaacataaagtgtaatacaggtagaatattataaggcaacgacttgtggaacacaggaaaagtgggaaagagatagggaataggaagtggtgtgatgaagggaatcttacaacattaagtaggaggtctgggtaggcctaattgaaaatatgacatttgagcaaacacatgaagtttgtcctgtggatatttgggaagttcgcattctaggcagtgagaacagccagggtcctggccctagggtggcatcatgtctgctgtgtttgaagagttgcaaggggccagtttggctggaggagagggatactggaaattaattagcaggcaataagtttggagatctaataggagtgaggtacctcagggccttttaagctattatagattttaggttttactttgagtgaagagaggaaccattgtagggttttaaggagaagggtaatgtagtgaagggatttgactgactactgtattatgaatagatgttaggaggggccagacaaaagcaataataccaattaaaaggctattatagtaatccaggcaagagaagatggtggttctgactagggtggaacagtagaggtgattagtgattaaattctgtattttgaaataaaaaccaagtgtatttactgatggttaagatttgaggtatgagacaaatataggaatcaaggatgactccaggatttggaacctaagcaactgaaaaactgcggttaccgcaaactgaatgaaggaaaatatttgtctccgttcgcctaacctgctgttattcatcactggtagaattcaggtggctttggttgtagaatataaacagaatattttgagaaaaatgaaaggaagataaaaataactagggaaaataaccatgttatggtatttaagttgcttttagctattttaatcttcatttctcttgaatgaaccttaaggtcttcaccatggctgcaaggagcgtgataaaattcaagtgataataatttacaatataaaggcttgatcagaaatagcatggacttcattttgtttttaaggctgtgcttcctgtatctacatataaatatttaattcctaccaaattgtatatgcaccattatgttaagctattctgtaaaatcttttgagaaaatgtgtgatgctatcttaacacaattaaattagtttcatccatttttcatctgcaaaacagcccatggaggtatttcaaaatgattaatttttcatacttattcacaaagcagttctactaatagttggatttttgtaatatatagttttaaaaatatttccagtatgttaaatacattatatttttcatagtgttttccttcttattagcattatgtaccagacaagatgcctgcgggaaagagatgacacactcaaaaagagtgactaaggaaggtttaataaaggtaatatttaccaaggtgtgggcacggttaagagaagtcagcaagggatggtgaagcttggggagctggtagggactgaatttttgtgtcctccaaaattcatatgttgaaatcctaatccctactgtgatggtatttggagatgggggttttggaaggtaattacttttagatgaaataataaaggtagggcccctgtagtgggattagtgttcttataacaagaggaagaaaaaccagagctcccttgctgccctccacctatatgagtgaacatttgcaaaccaggaagatggctgccactaggaattgaatttctagctccttgatcgtggattttccagcctccagaacttcggaaaataaatgttgtttaagccacccaggctatgctactttgttgtaatagcttgagctgactaagatagtgagtaggctcacaagaccaagattgctgtcttggtttttcaggtacctggagatagagttatatctttattttttatatttatttttatgtttttaagacagagtttcgctctgttgcccaggctggagtgcagtggcgtgatctcatctcgttgcaacctccacctcccagattcaaacgattctcctgccttagcctcctgagtagctgggactaagggcacatgccactatgcctggctaatttttgtgtttttaatagagacagagtttcaccatgttgttcaggctggtctcgaactcttgagtgcaagtgatttccccggcctagggctcccaaagtgctgggaccacaggcgtgagccaccgcacctaaggccagttatacctttaagtgtagctgtatctgtattagaagaccattgaaaagaagcagtaaacttgggtagaggaacaaatcctggaacagagcttgacctaatggggctcacacatgctgattctgcttgcatttttaattgactaaacacaagaaagtatattaggaaagggaacccaattaatatagttcctacaggtcagcctccagggggacacagcaagctatagagacctgaagagtagatttggagagacacacagaaaaatctagccgacgtgaaattattatttataaagggaaaattgatttacatcaagatcaacaaatatatcaagcattatgagtcaacacccctaattgtgctaagtagtcttcttagcttatatatataaagtttttattagaaaatatgttcaaacttacaaaaaagtggccaaataagaatattacaaagaatatccctatcccctttaaccagattcacctattgttagcattttactccatatactttattatatgctctgtgtctctttttatcttagtaatatattttatgttatttttctattataaaagcattgtcagttgaggcgttgggctgagtccttgactgcagctcagtaattgcaatgcgttggctgtaaataccaagtctagtgtggggatggtagctttccgccatgtgacctgacaggtaaaagcctttgtaattgcctgtagttaggcctcaaagatctcacacaggattttgggtcagagctggactcctcaatcctttgtcagaaattataattttattcagattaatttttattcatcattcttcctctgttttagctttaattctaaaaataaacatggaatgctcaacatcagtccttttttaaagttttttcactcctcccttggttggatgaagctcccaccaggtctgtcccccaacggaattacaatttgacatgagatttgaatggggacacagagccaaaccatatcaacatttctagcgtagttttgatacttctaattcaaagtgtttttaatgaccccaaatgtttcaggatgtttaattcaacatggaatttttttatttccattttttggctttatgtttgtttttaggagagttttcattaggagaaattgctttcgtcataattttagcagtcatttagcatcgatgtgatctgctttttctaacattatttatattgtaagtaggttcctcactaagagtatatgtgtacaatatccctgggcctttgtacgttcaaatctgctttttatagacttgatatatgaaacacagtttgactgaatgtatctttggctcatactttcattttttttaactttcttgaaaatatcactgtacttgtaccttgctttgtatgttgtttttcagagaagtttgatgaaattcaaattattttgcatttgtaagatattttctctctttgcctaacagtgctgaggatggtatcttcaaactctaatagttttgccagacatgtgccagagtttagtgttctgagtcaatagaaatgatgtgtcattcctatgggtggaatccagtcttactttattttgggaatgtttttcattatagatgtaataaatttttatgtgattctattttctcttggtaatattttccttttatctttatttctgatatgagttattctttttctatttctttctgaagtccattacattctcttatcttttcttcttatttgaccatttgtattagtctgttctcactctgctaaaaagaactacctgagactggataattgactcacagttctgcagcctctacaggaagcatggctgggaggcctctagaaacttacaatcatgtggaaggcaaaggggaagtaaatacctctcaccatgcaggaaacagagagagaaggaagtgggaagtgctacacactttgaaacagccagatctcatgagagctcactcactatcatgagaacagcaaggggaaaatctgctcccatgatctaatcacctcccaccaggtctgtctcccagcggaattacaattcgacatgagatttgaatggggacacagagccaaaccatatcaacatttctagtgtagttttgatacttctaattcagagtgtttttaatgaccccaaatgtttcaggatatttaattcaacatggaatgttttttttttcattttttggctttatgtttgttttaggagagttttcattaggaggaattgctttcgtcataattttaacagtcatttagcatcgatgtgatctgctttttctaacattatttatatagtgaacaggattcctaattcaagagtattcttttttgttattgttgctgttttcttttttcttatttatttctttattttttacagaagggtgttggggagaggaaagagttgatgtgtttttgtcaccctttttgtttctgcagcaaatatgtatttccttatttttcttcactgcctcatttcaatcccttatatatatcacattctcttaaggaagcagtggtcttagaaggctgccactttgatcctgcataccatcaagggtcttctgtatagccagtgttataaccaaacaaatgctgacccatgtttagtattttagcatttaatgatgcagtttgtcttttagggactgatttggtctatgtttcattgataacctctactgtcctcatgtttttcatgacatctcttatgccttctcttttgcaaattccatacccacagatttgtaatactaggtgacttggtagaaattctgctggaattttcttcttcccttttctaaaggtcatatttttcttggtctcctagttaaattgaagtcctgggttatgcttggattattttgctattattgattttataatttatttggaagggtgtggaggagattcagaatcaatggccccatcattattatccaacaccagaggttgccacttatctgtattttgaactagagcaatcaaaaattaatttaaagctattttgtttaaataatcatacaattttactctcataaatgatgaatattaaatgagaggtctagtttcaaaagcaagaggttttttgcagtaaaatatgaaaaataacaacttttatgggaaacagagcaacatggctgcacagaagcctccactgattttccttcctgcagggacaccaaatttaacaactatctacacaaaaaagcagcaccttcataagaaccaccagtcaggtaagccatgatagtacctgatattaacttcatgccattgaaagaggcacagaagagggtaggaaagaaagtcttgaattgtggacatcactctacccctatctgctggcagcagcccagtggcagggagaatctgtgtgcttgcaggatggagaggccagtgattataggacattgcattagaacccagcacttccctgtcacaacagaaagcaaaaacttgtagaacttagccgacactgatggaaggagcatgtacaccagccctagacagagaagaatcatccatcccagtggttggaacttgagtttggcaagcctcactactgtggtctaaggtgctcttgagtcctaaataagcatgaaaagcagtctaggcaacaagaactgcaattcctaggcaagttctagttctgttctgggccgagagcaagtggaactggggagcatgtgatctaatgagacactagccagggtggcctagggaatgcttgcaccactcctttcataactccaggcagcacagctcacagctctgacggcttatttcttctgcttaaggagaggagagggaagagtaaagagtactttgtcttggaacttggataccagctcagccagagtaggctacagcactgggcagagtcatgatggtcccattttaggccctagcacccagtgatatttctagacacaccatgggccagaagattacccactgcctataaaggaaggacccagtcctggtaggatccatcacttgctgaccaaagaaccgtgggaccctgaaaatcaccagtggtagccacgtaatacacccagtgggccttgggtaagactgagacatgctggcttcagatgtgatccagcaattcccagcagtggtgactatgaggaaagattccttctgcttgagaaatgcagagtgaagagtaaaggggactttgttttgcatcttaggtacccgctcagctgcactggggtgaaacaccaatcaggatcttgtagtcctcaattctaggctttggctcttggatggcatttctggatgtgccttgagccacaggggagcccactgccatgaagggtgagtcctaagcctggcattcaacacaagctgactgaagatcccttgggctttcagtgaacattgctggtagcctggcacaactctttgtgggtctgtggcagtggggaccacagggagagactactttgcttgttgaaaggacagggaagagtggaaggactttgtcttgtggtttgggtgccagctcagctgcagtagaatacagcaccacatagatttctatggtcctgactccagaccctggtttctggatggcatttctggacctactcagggcctggggaactctccatcctggagggaaggacacaagcctggctggctttgctgtctgctgattatagatcctttggaccttgagcaaacataggtggtaaccaggtagttgttacagtggagcttgactgagatccagtgctgtcctgacttcaagtctgacccaatacattgccagtggtggtacctgccacccctcacccagctccaggcagcttagcacagagaaagattccatttgcttggtagaaagtaatggaagagaacaagcatctctgcctggtaatccagagaattcttttggatcttatgcagtatcaccaacgcggtacctctgtgagtccacaagagccatagcattactgggtttggggtccccctaatgcagatatggctgcagtgaccaaaacttagatcataacacacaagtccattcaaaatcataggaagtcttccctaaaaggacaggtatgaacaagcccagactgtgaaggctacaattaattctgaattctgtaatgcccagacactgacaaatatccacaagaatcaagaccatccaggaaaacattaccttctcaaatgaactaagtaagtcaccagtgaccaatcccagagagatagaaatatgtgatttttcagacagagaatttaaaagagcttttttgaggaaacacaattcaagataacaaagagaaagaatttaaaatcctatgagataaatttaacaaggagattgaaataattaaaaagaatcaagtataaaatctggagttgaataatgtaattgacatgctgaagaattcatcagcgtctcttaatagaattgatcaaacagcagaaacaattagcttgaaggcaggctatttgaaaatacacaatcacagcagacgaaagaaaagaagaatagaaaagattgaagcacacctacaggatctagaaaatagcctcagaagggcaaatctaacagttattggcattaaagagaaagtagagagagagatagaagtagaaagagtttttaaaagcataataacggagaacttccaaaacatggaaaaagatatcagtattcaagtacaaaaaggttatagaacaccaagtagatttagccccaaaaagactacctcaagacatttaataatcaaactctcaaaggtgaaagataaaaaaaaggatcctaaatgcagcaagagaaaagagacaaataacatacaatggagttccaagtctggcagcagacttttcagtggaaaccctacaggccaggagagaatgaaatgacatatttaaagtgctgaaggaaaaagcattttgccctagaatggtatatccagcaaaaaatattcttccaacatgaaggagaaataaaaatttttcagtaaaaacaaaagttgagggatttcatcaacaccagacctgtcctacaagaaatacgaaagggagttatttaatttgaaagaaaaggatgttaatgatcaagaaaaaaatcatctgaagatataaaactcactggtaatagtaagcacacagaaaaacacagactattgtaacactttaattgtggtatatcaacaatgtatatcttaagtagaaagataaaaaataaatcggtcaaaagtaataacaacaactttccaagacatagccagtataataagatataaagagaaataataaaaagttaaaaaggttggagacaaagttaaagtacagtgtttttattagttattgcttttcctgtttgtttgcttgtttttgttaatgtaataagtgtcaagttgtcatcagtttaaaataatgggttataagatattacttgcaagcctaatggtaaccttaaatctataaacatgcaacagatacataaaaagaaagaaattaaacataccaccagagaaaatcatcttcactaataaggaaggaaggaaagaaagaagaccacaaaaccactataaaagaaatggcaaaatggtgggattacatccttacttatcaatggtaacattaaatgtaaatggactaaactctccaatcaaaaggcatagagtggctgaatggattttaaaaaatgacccaacaatctgttgcctacaagaaacagacttcacctataaagacacatagactgaaaataaacagataaaaaaatgacattccatgcaaagtaaaactaaaaaagagcaggagtagctatacttacatcagacaaaggagatttcaagacaaaactataagaagagacaaagaagtttattatttaatgataaatgggtcaatttagccagaggatataacatttgtaaatatgtatgcaaccaacactggcacagccagatatataaaggaaatattagagctaaaaagagacaaagaaacattggacttaatctgcattatgtctcaccatatacaaaagtcaactcaaagtggattaaatacttaaagctaagacttgaaactatgaaattactaaaagaaaaatttagggaaactctccaagatgttggtctgagctaagatttcttgagtaatataccacaagtacatgcaaccaaagcaaaaatggacaagtgggatgtgtcaagttaaaatcttctgcacagcaaagaagataatcaacaaagtgggaagacaacccacagaatggaagtatttccaaactgttcatctgacaagggattataaaccagagtatataaggagcacaaacaactacataggaaaaaatctaataatccatttaaaaaatgggccaaagatctgaattgatatttctgaaaagaagacatacaaatggcaaacaagtacatgaaaagctggaaaacatcactgatcatcagataaatacaaatcacaatagcaatgagatgtcatctcatctcagttaaaattacttctatctaaaagacaggcaatagtaaattctggggaggatgaggacaaaagggagccctcataccctgttggtcagaatgtaaattaatacaagtactatggagaacactttgaagattcttcaaaatactaaaaatggatctgccatatgatcctgcaatcccacttctaggtatatacccagaagaaaggaaatcagtatgtctaagatatagacatactcccatgtttattgcaacactattcacaacagccagggagtggaagcaacctaagtgctcacaaacagatgaatggataaagaaaatgtggtatatatacacaaaggagtaatattcatccataaaaaaaagagtgagatcctttcatttgcaaatgaggttattatgcaaatgaattggagatcattatgttaagtgaaataagccaggcactgaaagaaaagcttcccatattctcacttatttgtgagagctaaaaattacaacaatcgaactcagagagagagtggaatgatgattaccagcagctgggaagggtagtggggctggtgggaagtggagatgattaatgagtacaaaaatatagttagatagaatgaataatctctagtatttgataacacaacagggtgactacagtcaacaataatttattgtacatttttaaataacttttagttatttagtatccagtattttagttatttaatataatcagattgtaatacaaagaaaagataaatgcttgaggtgctggataccccatttaccctgttgtgatgattatgcattgtgtgcctatatcaaaatatttcatgtgccccataaatatatactcctactaaatactcagaaaaatatttaaaaagtaaaaagcaaaaacaatgaaattacgtctttagagggccaaaaggaagaaaaagtcaatgtagaattctatactggataaaaatattcttcaaaaataaatattatttagacaaaactgaatgcatttatagcaatcttcattacaagaaacaccaagaaagttcttcggcttgaaggaaaatatttgtaaatggaagcacatagtatacagaaagaagagaagagttccagaatgttcaaccatagatacaaagtcaatattaaaaaaaataactgtactgttagagactagcagcaaatgattacataaataaacccttaaaaatgctatttataatagcataaaatcatgaaacaccaagagagattttaatagatgtttgagacctctattttgaaaatattaaaatactgcttagagaatttaatgaacagagaaataaatggagatcatctataaatttattatgattctaatctatatttaagcatgtttcttttcttttggtggacattaaataattttaatatttatatgaaattcaaaagacatagctagaataatgtttaagaagaagaatgcatattaccagtttttaggattcattataaaattagaatagttaaatgactatgggatttgcacaaggatcacatcaagaggtgggataaactagagtatagaatagaccaacacctatacattgaggaaaggataatgtttacatgaaaatagtaatttattctttccatatatacaaattaacttgaaatttacaaaatacatgtctgtagtagcattcatgtttgtccccaagtaactagcacatttcaaggcacatgatggatattggataaagagttgatgaaacagtgacaacataaacttcattactgagaaagttttattagaatgcactactaaaataaaagaaaaattaaatttaaagaatgcactattaataacagcaataagactgatcctgcaagttttcttcttgaggattgaagaaatataaatgaatgctcatcctactgatggttgatatgtggccctagatttaaatttaaggggatttacaactgacctccagtctaggaattcatagtcactcatttattgagcctatcacaaagtagagttctttatttggtgttgaaggggccagggaaagaaagaaatggaaaagtggtgttccatgttgcttccttattactaaacatgagaaactgcattatgtaaagtgatttctaaaatttctatagttccacatattatcagtatcaacatatcatactgtcatatggttccatgtattgataataccattcaaaatagttgacttgagaagttttaatctaaattagcgtaaaaagcaaacatggaaaaaacacatatggatgaaatattatggagctggtgtcttttagtgaagaacagaagagatcatgaaaaaagaaataaacaaaatatgttaaaattcaccaaaaagaaaaataataaaatgatctactatcttctcctcttttatattgtgataaacagagattcaagtttttaaaaagaaaaattgggccaggtgcagtggctcacacctttaatcccagcactttgggaggccgaggcaggcagatcacttgaggtcaggagttcaagaccagcctggacaacatggtgaaaccccatctctactgacagtacaaaattagctgggtgtggtggtaggggcctataatcccagctccttgggaggctgaggcaggagaattgcttgaacccaggagacaggttgcagtgagccgagattgcaccgctgagctccagcctagttgacagagtgagactctgtttcaaaagaaaaaaaaaaagaaaaaaggaaaaagaaaagttggatcacttagctatatataaggagacaataaaatacttatggatggtttaaaatggataccaataaggtttttctataagttggatttctgtatttggttgtcttttctaaaactcctggaactaatcaatcagggccatactaatttgctaaaaatgaattttcaaaataatattgaaagtttcaaaaatcttttctgattcatgacttatttcttgcaagttagtgctttctctttattaattcaagcatcatggcttctttgccaatattttattcaatcctgaaaactagcataactgacatctatttattttcatgagactgatatagggggttgacgccatttagatgaagagctcagaattaaaattttctagaatttctgggtctttgtgttacagcatgtgtaacaactactttaatatccttaatcctaatatagggtcacatgaccttaaatgtaggaaatttgtaaatgagtgcttttattgcagacagaaaaaacatacatgcaatttcatctttttgttgtggattatatttttataattctaaatatgtttgaactttaaatactatgttagcacagttagtcctcattatttatggatttcatatttgtgaattttactactcactatgaaatatgttgataatccccaggccaatactcatggtgtgtttgctgtaattcacggacatgtacagaacattgaaaaatgtgaattgttcaaaccacatattccagtcatgtgagaagaaggcaaaacagcagtctgccttcttgtttcagctctcatgttataaacgagtgtcctttttgcagcctagttagtgccaagagctttgaattttcatccttttacttggtgattttacttttaagatggtctaaccatcttaacccaaccagtggtgaagtgctgtttatgatgaaatagacaagaagcacaagaagactatgatgtgccttacaatgagaaaatatgagtgttagacaagctttgtttagcgtgaattatagtgcttttggctgtgagttcaatgttaatgaatcaacaatacgaatatccagaaaaaggaagaggaaatttgctgagctgtatatgaagttgcttcgtaaagtgcaaaactaacatctgtaccacatgataaaactatggaaaacatggaaaagtggctaaatctgtggattcatgaaatgacaggcaagcgtagagaatagcattattttgatgcggatagccaaagaaatttatgctcatgttattcaggattttaaagatgctatgctaaatccttctggactagtgctacatggcccacatgtttcaaagagtgatagcatgaacatgataaacttgcaggtgaggcatattctgcggataggaggctgtgaaaaacatttttaaaagaattctgaattctttataattatgtttatgatggaacacatttatgtttagcttatagtttgtttttttatgatcaaagagactggagctaattgcatcttactctcttttcattatagtgtatataagatttggctcaaaacatcaatgtaaccctctagctcataactattactggttttccagactccagactaatacctccctgtttcatgctgtctcctttacagtgtgtcacccaaaagattacaaaatgttttgaaaaacccctaggacattgctgcctggttatatgtagtagagtactgatggtacctatctgtctactccttacagcaactggtggtagggctgcaactacaagaattagataaaattgattaatgatactgtgatctgctaccaagtttgctattggaaaatagttcactgattgtaaggaacacaaagaattaaatgaagacaggagaaatttcttctaaaagaataaaatgaagtgtaataatttcctgcatacctcagggagatagggatatgaaaacattttcatgacttcaggatattaatgtggcctatgtcagcgattctcaaattgtgatgtatcccttaaaccctttctgaaggtctaataggtcaaaactttttaaaaataataatagtatgatggttttgtcttgttcactttgttgacatgtgcactgattgagacaggaagtagtggttaaaatttctgatgtctacatttgaaggaagacagtgactacacatcatttataatgaaatgcaaagtaagtgtaaacaatactggcttcatcctcatgtgtgatgaatgtgtagagtaaaagcacttgtgcgactgtttgagttgcaaaataaagtagctagtttttcgtagaacatcatttttaactgaaagaattactatgggtaatttaactgaaagagaatctatggatgttaaaacttgggtattttgcagacattttctgtgaaaatataggaagtgagtcattcgaataaaacaagtaactatttattgccaatggtaagtcaaactttcaagtgacaatttgaattttagaaaacttgtatccatgttcactgtgaccctgatagttttccaataaagattattctgagaaaagttataaacaaacgtattttcatattgcatttgaaatgtgtaaaaatttgctaaatctgcatagcccaaataaccagtattttccaaatgactaatgcagaatgttacaaaatcatgaagaaatttaaaaattcattcaaaatgcaagataaatcaatatatttaaccaattagagtatgaaatattcattgtcagggcttttattttcacattgcaagtaaactgtaaggaactattacttgctgagttttgatgtagtatcaaagcaggatatctcaattatctgaaaaatctgccagaatactattccaatttctaacggaatatatgtgtgaaacaaaataacataacaaaaacaacatactatagcaaattgaattcaaaggcagatttgagaatctggctagtttctaataaggcagatactaatttttttaaatgaacaaaatgccatttttcttactggttttttgataataaaagtatttgatatttaaatattttatgtatattaatgttttaggtttattgtttttacattcaaaattcagaaatgtttttaaattatactgttaaatttaatacaataaagtgtttatagatgtagcccaaacaaatgctcttataggccttaatcatttttaagagggtaaaagtgtcctaagataaaaaattttgagagctgctataccacattttgaaaatcatagtataaggtttcattattatcttaaataagttatgcttaaaagtgaaatggtagttaaaaaggataatcaaaaggaagatctcagaacttgcttgagatttggagagccagtcgactggtataacatgatacaaggactcattttcaagtgtgaattacaatggtaacatttattgaggacaattaggtttttacatacataattttgttttcttttcacacaacttgttgaggtagatactattaccataattttgtagatttgaagaacatagcccactgaattttggtaactttactgcacacagaaggagagatttgagaataagataagggacacctccctgactaattcattctatgaggccagcattctcttgataccaaaatctggtagagatacaacaaaaacagaaaacttcaggccaatatccttgatgaacataaatgtaaaaatcctcagtgaactactggcaaattgaatacagcagcacatctaaaagctaatccaccttgattaagttggctttatccctaggatgtaaggttagttcaatatatgcaaatcaataaatgtaattcaccacataatagatgcagaaaagtcctttgataaaattcaacatcacttcatattaaaaatcctcaacatactagccactgaaggaacatacctcaaataataagagccatctatgacaaatccacggccaacatcatactgaatgggcaaaagctgaaaacgttccccttgagacctggagagagacaagatgctcactctcaccacttctattcaacatagtactggagatcctagccacaacaatcaggcaagagaaagaactaaagtgtaaacaaataggaagagaggaagacaagctatctctcttcatggatgaaatgagaggtgagaggatcaaaaaactaccttttgggtactatgcttattacttgagtgacaaaataatctgtactgaacccatgtgacatgcaatttacctatattagaaaccttgacatgtacctctcaacctaaaataagagtttaaaaaaagatactgtcaaaacaacacagttctttctatttctgttgtaccactttgtaatatcaaagggtcctttcttttcctctttaggtttcgagataacatccataccatacataaaaccaagtatagttgatttttatactactttttcattataaaattaatgcatgtaaaaaagtatcattaaatattcctctataacagttttagttactaagtagaatttaactgtatggctataccataagttatttaattcctgtcattgttgatcaaatatattttcaacattttgttatcgtaaatgatgtagcaatgtacactcttcaattataattttgaatatatccgtaattccttcacaacacgattaaaactagaactattaaaatgtacctctagattgtactgcagaaatattgttgctgttaatattaatctagtctaatatttattgtcagttccctactggggtaaatacttttgttttatttttgtttgtttttatctctagtatcactaactaactttgcattgtttcatgtgatcataggctatttgctttgtaaaagttattcactattgaaatggtatgtgtcagtcattgctctaagtgttttatatatatacacattacatatatatacatatacatttatattgacacatttatttctgaaaacaaccctttgaaataatgtaccggtcagattaggtgaagatatgctgatataatgagcaacactaaaatctcagaggcatgcaacaacaaaattttgttgttgctcacattacatatttattgtgggccaacagcagctctgctctccctcttcttcattatagtacccaatctgaaagattaattcctattggaatttttaaaatcttacggcaaatggaaaagggagggggcttaaccacaagatgactcttaacatttctgtgtgtaagtggttcccatcattttagtgcacattgctttgaccaaaagaattcaaatagttaaacacatcttaatgggattatgatttttagttcctccatatggagaaggatcagaaatcgcagtcatgatatcaatgagcaacagaaagtattcttgcacaaagagggtggcaaatatttgagaacaaagacataatccacattttgtagatgagaaaactgagatacagagagtttgagtaacttacccatactgagagatttaataaatggtgcagctgggatgcaagcctgagcactctggtttcaaggagtgtgctctggtccaatgatagaagataaaatttatccagaaaaagttacctagcacctcatagtattttacaaatatgacaaccctagaaattattgtccaaagttggaccctttttcttggataaatgctaaactgggtgggatatattaactagttttaacctgggattgtcccaattaaaccaagatgtgaggtaaatcttgaggcaaattttataaaacattatactattgggtagtaattaagggttttggcaagcttgtttaagaagtaccaaccaaggaaacacttattatagaggcttcactgcaaaatacgttatataataccctccaatgcacactaagtttctgagttggttttgcttctttgctatattctgtaagtgaaacttattaacgtttgcagcatttcctaaggtggtctctaaaatctgctctattttagcacttttaaactaccatttgaagtaacaaatatttctaaaggaggccaaataatagttgtaaagtttgaataaagcaggataaataacaaaacacactaggaatttattagtataacagtgaaaagaagcaaaacttctagacttgagcttatatgcttattgttttgtgtgcttagtggaggaatgtataaatgcggctgagtatacaaactataaaatctctaattttaacattgcttgtttatatattaggaacttttaggggagttttgatttgcaagtttttataggtttaccagactcattaattgcctgggaagaactttacaggatttcctttggtttatgtctaatctttgaaattggaaaacttaaaagtgaaatataaattcctcatggagaagtgatcatgaggtctgaatagaatcaggtaattcccaagagacatgcaagataataataaagacacaaaaaattattccatatcatttgtgcccttatttgtgagtaaaggggtggaaaataaaataagatgtcattttcatctattgaattggcaaagattttaaaatataatattgaatggttgtaagggattggtcaaatgagcattctcttatatggctggtgagaatttaaatagacacaaattttgtggcaagtagtttaaaatgaaaaacacacaagaatttatacatgttcttagtcattgacatcaaggaatgtatgctttggaaatacccacagattttaatgacatatttatcttctagaattatttttagtgttgaaaaactagaggcaataatgaaaggttaagtaaattatgtctgtccacatgggggaaggttacacagcatttttttaaaatcatgctttcaaataatatatcttaggaaattttaattattcaatcttgaatgaaaatagcagtctgcaaaattgttaaacagagaatggtcacaatttttaaaaacagaaggaaatataatcatgtatcagattaacagcagttgtaaaccgtgttgtagaaaaatgagtaatgtttgcctttcaaaactatggatattttccaaatactctgcagttttctaattataatcagaaaacagttattaaacaaagtgaaagaaattaaagtttaaatttaccagtataagttgcttctttggagggtatattttaacttattgactaccatcagatttactaaatatcatagcacgtaatttcatttaaattcaccacacattacttttctatgtagttcatttaccacaggtataatattgccatttgtattactagtagaaattatacttaatacattgaatttatgccataggaaaaagaaaattaaaattatgttcttattgtatatgcacatattttcttcttgataaaggatttgtctcaaacagattgtaatgacagatgatagctatagatagatagatagagtaaacatgtaagctactacaaggatccaattagagtgaatttaggttggaagaaggttctttcttcatctttctttatctctgaataatttcaaagttgacagaccatggttgctgacatctttattgagaaaacaagagttttgcccacgcttatttaaatgtacttatattttcctgtttgctttacatattacatatgatgaacttttgaggatgggggtcataatttcctttttttctatctttctgaactaaaatatatatgtaaaaactcaataaatgatagagaattaattactgaacatatgtttgtattcacacagaaaggtggtaaatatagaagttgataggcagcttctagagccagatcacttgtgtttaaatcccagcattgctatgtggcttcaagaaagttactcaatttctctgtgcctcagtgacttcaattcaagtataacatgaagaaaataatgctactcatctttggagtggtgaagtgacttaatgcttaccaaacacttagaatatgctggcatatggcacatttagctattatcatttcaagataatttccttgctaagtgactataatgattacaactcataactgtagctttgaggaatacgtacacatattcaaagctgggaattgtttgttggcagctctactggtatatggagggatacagaagaaaatcatcatatgtacagctaatcaccaagagatttatggatataaagaaatacatggtaacaagaatgtttattgatgaatttataattagtgagataaaatttacaaatggtatgggatatcattaaaaagcttttagaaaaggaaattcttatggggtacacaaaacaatatgaagataaatatttgtgaactggaaaaagctggcctttcaatctagacaggatatattatgcaagtagtcacttaattgagcctttcctttttctgacttagataattgataaaaaatatatatatttttatttcagagcaggatggaagtttatttaacagctttataacaggaaacaaaggaaagtactcttggaagagaccacacaggcaccttggaggtcaagtgacctgtttaaccttgcacctcaaattttatatgctggactacttctttcatcttgtacccctttccctttattcgtccctcatgatgagtcacccacatgcatggtgccctccttatgctccagagatgagcatgcagagtgtgattacgaagttgcttgcatacttacctcaggcttttttccatgatacaaaggatatttttgaaatacaaaaaataaccttttaagtaatttgccaatgtaaggcattatgattactacttttcttattaataatcatcatcgaacatagaaaattaaagcaaagtaaaattaaattactttgcccctccattggagaaggaatattaaggaaaatttacattacattttattcttttgtttattttttatatagttcttgggattgcattttttgaagttgagtatatttgggtataatgtgctttaatacattgaacttcttccacccctttgttttctaaagggcttttttgttgaattttaaaggaagtttagatttttaaaaacccaacattgttgttaatagagttgaagatacgtgcgtgtgttatttcaacaaaggctgctgggtggaatgtgtactgtgggaacctttatttaagcaattttgctgctttagttgcatcctttattcattctgcaaaaaattcactagccatgagctggagtacggctactcttttcccattcccccactgttgatcaaataaagctatggaaaaagaaggagagggagaagtaaaaggaaagagaagaaagaagaaggattaagtattaccttcaggaccaaagagtggaagtattttctttaacatttaatgaagtaaataaagggagtacaaagtcaagtagcaataagaaaaacttgaaatgcacgagggcaggaaattgctctgtaaatatgattaaattctagacccaacattcagtggaaacaagttttagaatttttccattagagatcattaaaaacattatttctctcaaacaaggtgacaagtggaagagcgtgcacttgatttctaaattgccaccctccttagattcttctgacatactagcagtggccaaattccaatatacattcatagttcaatgcaccttttcatactgtggaggcacctgcatatccactttctccctaatcctttgactattcaaataatattatcaatgcacaattatgtcagtgatttttcttcatgaattgtaaccctgtgctagctaaagtatgtcaccatcatatcagtgctagtaaatattgtggttccttgggtgaaactcaaagacttgtattcaggatccttaaacatgttatccatctagtttctaagagggaggacaggaaatgtttagttttaaagtttagttttttgtgtttttcatggcctgtagcataagtccccatgttgcatagtcacactgaaacttgatattatattttgtggttgctgtgcatccaagattcctttatactcctcacatataaactgagttttatgtccttactgcctgaattttccttagaagtcctgtaatccaaatgattttagcatcaactccacagagaagtcatgaagcctgtagaccatactctatgtaaatctctggttcatttctcgttgctaatctccaccctcgtacccttcccttgactttgtcacttgtatttttcttttaaaccctttccatatttaaaacaccacaatattgacatgtgagccatcttctcgagagagaatcaggtattctcttagccttctaccttctgttgccgttccaaggctattactgtttagagcttaacttcttgtaataacttgcatcactccccttgtgtcctcttaacaaacaatcacatcactgctcactcatcatttccctcaatgtgacagtatgaagaattcaatttaatccttgctatatgggagtgacagtagaaaactgggccatgatggatcaagcattatcaattccacagatgctcttacccaaaactcaggtcataaatactgtgaacgtgccctgaaaatactttctacttgtatcctcacccaaattatacgcatttataccatagcgcaatatattcccccatactactgaggaaattcctatatctatgaatgctacaagagatccaaatgtagtttgctttgaaggtagaccattgtcaaatgaccgttgattaatcttatttatgctttgataatatgtataatgtttaacagcttgaagtagcctcaatctttaatggacatttgtggtgaaaccacaataaaacagtgcttgagccttgggttttcatagtctctaggctctaattcaagcaatttcctatccatacaaccaatagattcttcaaatatcttgtgaatatgacaaatttcttctaaaatagcatagctttctagttcctagcttctgtttaaaatctagaaaccaatttattattccctatccaaatagattccctaggtacataaccctatatccaaaggttacagtgtaaatataaagagaactttatcaatggttttatgatgtgtatttttaaaggaattttctcctttgttttttaaaacaatgtaacctatatgaattttgttttcatcttaaaccaaatgaaactgaagtaatatatcttacctagggtcagaaaacaaagatacaatggagttgagatttggcttggtggtgttgtcttcacattagggattttcctctgtcttatgtgccagagcagttgagaattctatatgacattaaaaatctcttaatttttagttcataaatattgaaaattaatttgattattgattctgttgattaaggttgttgcacataaacgtgcctaaaattccttagtgctcctactttctgagttagctggaatgcttgtgctttgggcataccttatgtgcaactctattgtgatgaatattatgaaatgtaactgtttcttcactgaaaggaacaaatgataaatatttcatcgaatgaatacgtactattgttgttgagctttctgagttggagaaagagcagactttcttgaggaagtggtttcgaatcagaactagaaagatgagaaagacatcttccttccattttccatggccacctctgcttcagactcaccttttttctgttcatatcctttgcccactttttgatgggtttgtttgtttgtttcttgaaaatttgtttaagttctttgtagattctggatactagccctttgttagatggatagattgcaaaaatttcctcctattctgtaggttgcctgttcactctggtgatagtttcttttgctgtgcagaagctctttagtttaattagatcccatttgtcagttgtggcttttgttgccattgcttttagtgttttagtcatgaagtctttgcacatgcctttgtccggaatggtattacctaggttttcttctaaggtttttgtggttttaggtcttacatttaggcctttaatccatcctgagttaatttttgtataaggtgtaaggaaggggtccagtttcagttttctgcatatggctagccagttttcccaacaccatttattaaatagggaatccttttcccattgcttgtttttgtcaggtttgtcgaggatcagatggttgtagatgtgtagcattatttctgaggcctcttgtctattccactcgtctatatatctgttttggtaccagtaccatgctgttttggtgactgtaggcttgtagtatagtttgaagtcaggtagcatggtgcctccagctttgttctttttgcttaggattgtcttggctgtatgggctcttttttggtgccatgtgaaatttaaagtagtttttcctaattgtgtgaagaaagacaatggtggcttgatgcggatggcattgaatctataaattactttgggcagcatggccattttcatgctattgattcttcctatccatgagcatggaatgttttttcatttgtttgggtcctctattatttccttgagcagtggtttgcagttctccttgaagaggtccttcacatcccttgtaaggtgtattcctaggtagtttattttctttgtggcaactcacctttttatgacttgcaccacggataattaagtgatgtctttgtgtcttctcaccagacaaccatgtccctgcctgacctttccttttatgtgacagtagcagcagttgtattttagttcctgctgaagtgaagaaagtgaagttttaaagaaagtaatggtttgtgaattgggatgatatgacagactttagtaataagagtagtttgcctgtgttggagaatcctagaaaatgagtaacaactgtcatgaagaatgattcaaacgtgatgttttcattgataggaagagagaatgatcatatctgcaacctaaggactaaaagagctgatgtcttgggctccgtatccacataggctacctctggaatactaaaacaaatgtacttctcaatttttactggagaagagatgcagtttaaacgctgccacagagttagtatttttagtgtcccaaacaataatggtccagatgtgttatttcaactataaatttcactttttattgtaaaaggttaaagaactttacaaaataatttttattaagtttcttacatttgtttttctggccattctctctatagttttctaattataaattaatgatgggaaatttattaccaaactggttcacaagattctttgtttacatagtttctactataccagtttgacttgaattataaaaattaggttgatatatctcgagtatgaaaggaccctttaaaattcaattgtgagctgtgaaacaatattacaactctaaggtaagcctactaaattttaggaaattgattttaagtagagtataatgtaatccctaaattatttaagtctacttggaaacatattttatactgtaaaactgcttactacaatactaatgctttcacttgcctctattacaaatgctgaaaaactcatattaaaacaaatctatctttcatgccaactataatacagatattgtgtcttagttaaaataatagggaagcgtgttagtgcccaggtaagatttcatgctaacagtgctgcctaagaataactttatataaaggtttccttcttctttctgaaagttattttttaattgctcaacataggccaatccttagtgacattgtatttgaaattgtttaagaatctatttatattttgagtaacttatcatgattaacaagtttgaacatttgccttaaatttgttaagaaggaaatttctatattctctttcactgtttacttttttcttcctcagtaaggcaatttaattgctttcaagtaatttcaaggtcatccttagtttttggtcttgtgcatgttcccaagaacttaattatagaagtttttctgtaatgaatatgacagagaacccaactctacacaactgatctatatttatgttcctactgaggcatggtagtcctccttccccacacttgcctgcccatgaaatcgaaatatttggcaggattaattctcaaaagataaaaacactctaattgaagaaaagtatcaattcaaatcatatcttttaagaagaaatatattctttactttcctgcttaaatttgaaatagtagcagttgaaaattgtggattggaactaattactgattaaaacaaagtacacctatgagttttaatagaagcagtaagagtaatgtgtaaatgacttttctttgttcatggaaaccattgtggttttcaggtgcagcttaccttcacaaaagctaattgtagagataattacatccaaatgcacaaattggggaaaacacagagaagcttcattcagaattcactgacactatgaaagacaggatggtataaaagagttagtgtgctctgaaaaaggaagttcttaaaaactttggaactccagagtcttgggtttgatttctgcttccatcatttaattgaatttcaggcaggttatctaaactctgcctcagtttgctcattgttcatgcaacagagtttctatgcagactacacatagtaatatattttaagctttagacataaatagagttcattcctcactgaccgattttcttttaataaataaatcattcttaaaatttcttttcttgaagtacgttataggtcagatacaatagctcacttctgtcccagcaatttgggaggccaaggtgggaagatggcttaaggccagtttttcaggaccttcttggacaacagagtggggctccatctctacagaaaaaattaaaataaaaaataaacgtaaaaaaataaagtatgttgtaatttggcctgtttaatttgacaatgccattagtagtatacactggaaagctgttatactatggttgttgcccattgtcagtaggcaacatttcaatgagctgtaatgttaaactgaaaataccctttttcttgagcaattatgtgctatttatatataatatatattatgtgattatatatcatataataaagtatatattatatagaatacatataatacatttacatataatatgtataacattttctataatgaatacgccagagaacccaattctacacaactgatctatatttatgttcctactgagtcatggtagtcctccttccccacacttacctgcccatgatatcgaaatatataattatatgttatacatattatatagcaattataggcatcacacaattttctttatatatcaccaattctatttatattatatttacattatgtaaatatatagagtatatttatatgtaaatatatagaatatatgtaaatatattatttatataaatcttaagatataggtatgggcaattttgattttacaaacttcttcagggttctgtatatccatttgcataaagttttgattgtatgcatttttatatgggacactgacttatttttcatccaataaatggtaaatttctatccattagaggatttacctttgatttcattttggtgatactttaaatcataggtcagctattagaaaaccaattacaaattacaacgtggtaactaaatgatatttactaaagcaaagcatatcaattgatatttttaagttatatgttagcatacgcgcacacacacacacacgcgcacgcgataggatccagattgatgccctaataaagtaacaagttagttaaagatgaagtgaatttataaacataccgttatataaaactgtctagatagaacaaacaaatatcacttgtgatgaaatacttgaaatttagttcaccacatgcactgttgccatcatttttttttatgagaggattcagctattgtatcgagtgtttgcaagcgtgaattcagaatcttggtaggaaaaaggtaaaagacaaattgctatcttctgaaaggaggtgtgaattgttcatatgtgcagattttacattaacgagaaaccttaactttctcaaaagaagaaaggcatttctaacaatgttacgtataacatatttttgttcttctgaaaacttgtgtttcattttcttttaggaaaaaaaaaagatcagactcttaggccaatttttcagactcttctgtagattacttgagcagatatgaaatcaataagaccttaggtaaacagtatggtacatattttttttaagtctctgatacattgagtctcaaaatatgttgcacattaaccgaagacatgtttgtagaattcatagcacttattatatcttgattatactgaaacatttttaactttgacaattataaatccatcttgcagtttctccaaattcattttattttaattagctatgatttgacatcatagtccattatacacttacttgactaagtctatgctatcagtttttctacaaccaccacttcctatcagtaaataattgaaaggctttattcttataaagcacaattatgtttgcttgatcagtagtcttcaactatatctgctcatgtgtcccctaaaataattgagaaaaatagtataaaatcaataacttttgaattcaatacattcaagcaatgatgtcattatatatgtggttcatcttcctgacacacgggagatgtttctcttagacctcagtgccagaacagtataatttcagagcaacaatactattttcttggaatataagtgggaagctcacaactattcatatttctctctttgtcaagaaaagttataaggtttaacacaattatgaaagccagaaaacaaatgtatttttgtagcacttttgtagaaactcctggctttatgttactgtctctcactttccaataatgctttttttaaataatggaatttgttatgtgtttctgcaaattgcatgatatcctttgtgaatgaagtagatactaattaactatttctaaacagaccgctacaatacagtgtgaaaagttttaccataactgaaaatgtgttaataaagaagtggctacaggctgtgtctcatacactgtaattcttttcagtagccttgcatctctaattgattttgcagtactaaggccttcatttcttctgttacattccaatattcttttctcttgttttatctttagcattaatagatatgaagaaaaaaactatcctgtactttaactagattcagacgctatttccttttgttcattaatcctacttaaactctctatagtgtgtattttaaaaaatgtttgtacatgctttttggaaaagtgctatatatccagctaatcatttctatatacagttaaaaagtagaggtaacagtgcttatttctttatttatatatttagaggcggagttttgctcttgttgcctaggctggagtgcaatggcacgatcttggctcactgcaacctccgcctcccaggttcaagggattctcccacctcagcctcccaagtagttgggattacaggtgcctgccaccacacccagtttattttttgtatttttagtagagatggggtttccccacattggccatgctggtctcgaactcctgacgtcaggcgattcacccaccttggcctcccaaagtgctgggattacaggtgtaagccaccatgtccagtcagtgcttattttaaaatgaaacatcaggaacattttgaaaaacatttttgcataaagtatcagggctatgtttttgttcttgataccaattgccagctgattgcattattgtgtttaaaattatcctggggcataaatttatccagagtctgatctaattaatttcaggctcctttgcagatagttttagggaccaatcatctctgagattttttgtgaacacaggagggctcttcttgattttctctttacctgattatctatggtgaatgaatagctgacccacagtttagcttgatactctcatggagctactatcctctcttaatctcacttccaaaatctctattattattcagagtgccttcaagtttaaccttccccacactttattccaaacaagtgagttcctttcaggagagctttggagctctgttcttatggactgcctactccatgggcaaaattcctgtgtctccctgctctgtagttggctcctggacagtggtctacttctctcagagtgatactttggctttacgggcagggtactcggtggagtgataacatctggtcttcctcttatagcttgaaactttcctcttatagcatgaaacttttgccctttgagtgagtagaggcaagggtgatcggggcccgcccattcgttttcttggcttgccatacctggagtagagctttcaccatagaagtggggggtcagacaaaggaataaagcctagacctctcagccattgttgcctggaagagattctgaaacagagatttgggaatgggggctgagaaacactggtgctctgcccttgaagagaagataccacctctcttgactaggaatggacggatagggagccctattgttcttggctgcacccatctggagtggcgcttctctcatgctcagctgtgggtgagctgtgggtgtttgtggctcaaattccacagactcttgctgctcttgctaagatttagcagaatttctaaaataaatgtttcttcctttactgtctgctcttaggacaatttccagatattaccctttttttttttttttggtataaccttcaccacttatggttgttttgctgtggagaaggtccacagattctagattctgccatcattctagaaaccatctctttgctgcctacattattaacatcatttattgtatcttgtttaaatgaatacatatatttatgtgtcagtaattgggccagatactaagaggaaaaagatgactttgtcatgagtgtgccttgcgagaagcacaagtttaaactggaaaaatgtaaacaatattatcatttgtgtaaaatacaaaatgatgtgagtacataatatcattgtgaaagatatctatgcataacaagataaacactgggtgataactttagtgtggaatactcctttgaagaaatcaaaatatggggatatttatgtttattggaaataaggtgaaataactttactaatatgttattttctggaaataggtgaaagtctacatcattctatggttcccttattttaacctgtaatgtcagctcaatttctattttatgaaatgcagatatgaattaatcagcttttattttataatagtaagaaaatatatagattttaaacattgttctaatagaaattgctatttttaacaacttaaaatttatttcataaatgtaagcccaaaatatcagcacaaaagaaatgtcaaacttgatttacccattccattctttggaaaacctagattttctatcctacagaatgtaccttcagcacttttctcagtctgttttaaaataacctctgtgactgagcttctaccacagtctcaggaacctgttccataattcatttattgttcagagtcaggaaatcgcttcagatattcaactcaaatttccgttaccattatgaaaataactttcctctattaggatattttatatttatcctattcactgcctctaagtttttcccatgccacacaaacatgtatgtcacaaatatttatatatttgtgtgatttaagatattaaaaatctaaaatacaacatttaaaaaaccgaatctacagtattgggtaatatttttggttatagaaagcaatcacagaattttcacattggactcttttgcatgaggatttagggttcttaatttgataagccagacaaattattatcaatattatttacaaagatgaaaaaaaaacctcaggaaggcccaattgtttgcagtagctataaaaatggcctaaattatcttaaactgcataaacaggttataatattgtgataatatgcagtaactgactctttgtgtattttactactagggctatatttgaagtctagtgctcagatatttgatgaaggctcttacaatattcttgttgagaagatctccatttgggagtgcagacaatgcagtataagctggattatgttatgttgtaaaattttatttttaatgtgtataaatttatgtacttgtatagccatataaggaaattttatttatatttaatttttaacgttctgttcttactactgacttgaatgaagacaaagagcatttttattatgtgtgtaaaacatggtccattttgaaaggatattgattatgatggctaaaaactcaagactcaaaataatttttacaagctaaagaaaataaccttaccaatataaataatttgtattaaacattacaaaatatactaaattaaaaggatgagttattaccttttattatttttataacatacatcatactttctgaatatatttcattcttaaatgtatgcctttgttagttctaaacactagaaatgaaggtatttatcaaattgtttatgtcattttcagtgtcttctgtaatatgggattattgtattaaatcacttatttaattcatttataaaaatgttagtaaactgcttattcagaatcagtcatttctgttagaagataaaagtaatggttaaactgaaaggccttttatttttttccactatattgaggtaattttaactattcattgagataagagatattaactaatgactttgatgaaatgaaacaaatgactagttaaggtagactctatagtcaaaaactaaatagatcatttaaattacagaactgctttaaactaatcggatattttattgtaccctgagagtttattataaaaatttagataggcaaaagccccatctggcaaccgtgttactacaagctaagtacagagaatcttgctgccagcagaggcatttcatgcttcatgtctggaaaaaaaaaaaaaaaaaaaaaaaaaagctataatttagttgtgtacgcttgttcagatgatttcaagttggtgcttttgatagtgcaagttccagctgctcaggcctatgagtcctcttgtgaaaaattatgaaatcccagccaagttaactgcagtcgtttgatagatctcatgtatattggtaggaattgctgtacgttgctgtctttagagctaatgttgttttaaaataagaactatttaaaatcattaagaagaaaatctgaggcaaatatttgacattttgtatgcattaaatggctctgtcatttttgaaggtattttgctagactaaatgagatgtgcaaaatgcctgttataatatggatcttttggaatttaaaagcatctacccaatttgaaatgtgtactccatgtaggctatagctcctttaatgctgaaaatatcttccccaattaacttaattaactggaaactgtcactgttggcactgcactggcatagccaaatacttaaaaatgtgaaattattcttgctagaataagaagtggcttgaagggtaaccaggaatgtacttaggggctagttaacagtatcaagcctaagagaaatttacatttacagagaaacatcatttactccatcatcatcatgaacagtggtaactgatgtgagatcaggtgaaggagcacgttatttgcaataggaaacatatattgagtgttcttgtgaagtaagaggcatgaagtacgactacagggaatattgtggggtgcaggcagctgagggtaattctttgctttaaaggatttcatgcagagaaaaatgactctagattctgtgccatgcccaaggaagaagctggatttcatcccagtgcttgttcaaaaaataaatgtaaaacgcacaacacgtctactttgaaagcactaaatagaaaaaatttaaaatataaatttaagtacttgaagtgaaatactcaaaagatttcatgtaccattaaatgaaaataatgtagccctacttatgtctcaatagaatctcaattgtaggagaaataaaattatatgagtaaagaaaatgagatgtgaaataggtagtaaatggtgaatattcattttaaactgtatctttttataaattatttgattataggggattctcttttactttcttcttctatgattactttttgtaatatctataactagaatgccaatgattgctgagtgttaaaagaaattcaaacatatgattaatgtttggagtaaagagtaattaatgcccataagcattttttcaattttaaattttagctaagtacagttcaacaatatttatgtagcatctctaatgtacctgcactacactctaccttcacaaaaatgaatcgagcatagttgtggtgtgtggtgagtgtccagcatactgtggcaccacaaagaaggaaaacagttcaaactgacagtttagaggaaacttcctgcaacagctgccacattaaagatgaaatagatgaataaaaaataaataagttaaatgattaattaaatgacctaaaacgtttaaagcattttgccacacattatttcttttttttttttttcatcggactcttatgggaattccagatgcttcacaggatatttttctcattttgcaaatgagaaaattgatagtaatgcagtgaacactcttgtctaatgttcatataatccagtgtacaactagtgtattaaagagcataactcaaagccaggtaataatcttgctctaagtatattctccctccttcccatcccccatcaatctgcttgttaaactcgataaaagctgtcatgtaataggcagtaagtcagctgcctattgacttgtcatacaggtaagatcttttggtatgatggttttggtgcatatttcctatctgtggagactgtcactgtttagagtttggcatttaattttcacaagatactgcatagttatctcagagtttataaagtacctttaaaacatggtttatgcagataagttgttattactgtttttcccaggccgatttcttatgtttaatactcagtgtagttgggcagctcattaaagccaactggacaaggtcctatgaaactaggccactaggcagtttccagggtagcaaagtatagttcctttccaatgagtaaagcaataggtgcagatcgtgaaaggaaatatctgggccatgtcctgttcacctctcaggttgcttgctcagctgtaagctttggtgcaatgctatacagattcaacatatattctcgtctatcctttattactccaaactcttatggttactaaggcactcattttataacacaatgggatataaaataaataagaattatttgccagaagtaattcctgccttaaattggacaactcagatgaattctaaatgcttatttttgtgagaaaatagtatttgtccaaataaaaaattaagatttaccatttaattaatgtatattcaatattctaattaatcaatcctcctctttttctatttttgtctccttccaaacaaatttttatatttaatttagcactgagtagtcatacataatatttaattggcagactacctttatttttaaaggcaaatattattcatttaacacattctctttgtttaaatgtcaactactcatctcccagttagttatcttgcttaccttcatcttgaatatttccattttcagatttcttaatcttatgcaacttacttcataaagtcctaattcatgtgttggattaaggagaaaacatgaataaattaatttttgaacataaataatatgtatattattatttttgtcaccacataatgccttctattgattaagttcccaatacctatatttttgtattgaatccaggtccagtttaaaaaactgaactcttttattttcaatagagaaaatacttacatatggaagatattctgtctttatcagctctgcttgatacataattgactaatgttagaaatgttttcaaaggaagaattcctactgcaaatatccatggcttaataaatctggcatgtattgttcatatacagccggttaattggtgtcctgacacatagcttctgcataattccttcaggtgttagttcattgtccagatgatttaatatctttgagtatcattcggtctcatccctactttaaaataactggaattattagatctgctactagatgatgctataggagatatttacatagaataatatatgttactgtatcacaaatttgtgttttaaaaatgtttgtgataactgtagttcaatgtaattgggtgttttttgcaaccctacacattttcactggaatgcccaagggatctatggaacaaagaaaggtcaagaacccctattttaaaattgccaataacaagctaacgttcacacatcacccccaattcattcttatccttaactatttttttaattatgcttaatgcctatggtttccctacagaagagaaacagaaaacaacagtttttttcttaatatgtgaatagaatgtacttctatatttattcagtctttacttccaaatatgctaattactaagcttaataagtaattgcatagttttatctgaatgaattttagggcattaaataattcacacattttaaaatatactggctttaatatttaaatcttgaatacactggttttgattttgtcctatgttaaagatgtcagtattgataatgaactcctgaaagttcaatattgtgattttcaaagtgtgctcatcagctcctataaaccacaaaatacatagattaaagtaatctctggataccacatctataaaacatggtcttgtggtcttattagcaaagtgctagacaaagtagcgatatgaagtttctttcgactctgagaacaggtattatattctatataatgccaacatatatgtatgtataataaggatgaatatttatatttattcttaatatatcacttttagtatgatacatatttttacacaaacaaattgaaattgaatttgaagtcttccagtggaacgtacctaacatattcaaataaagtaaaatctcaagtcctggtaagtgtttcttcatccccatcaccaactccattactggtatttggtattaggtacatatccactcctcttctggcttctggctctgggacatacccagctggcataattggtagtgtggagaagggagacaaatagtcttcctacaaaccagaagaggttcttaagaggcattccacctttccaaccactgtgacattgagatggcttacagtaatctcatgctcagttaaaaatgacaaaaatatttctcaacactaaaatgattctcaaagccttctcatttcttgtatatacaaagactcagagacttgcatacacagataaatttatcatctcttacagaatcttctcaactgatattcttgctttttgatttctatcagaaacaaccatttcccttgctattattgattagttataaaatgccatcctttcaccatatagtccagatactattaataacttcttgttggctccaggacaaattcaacattagtagcatagttatcaaatccttggtagtaatgactatgaagagcaccaataaatagcatgcttcttccctatacaggttctaaaaaattaaaatatctgaaaaggtcttaataaaatgtgacttttattaatgataaagatgaagttggaagatacagcttattaagagggcaaaattgccctgttaattgaatcagagaatcaggcagatttagccaatatgacacagggtatttttgtcctttgggagaaaaaattccacatcatcaaaataaactagtaagtgaataagaaaataagtaagtaagtaagtaaataaataaatattttaaagccttaaaagacataacatcacattctgaatttactgccaattttaagaagtctttatttttatagaggatttgccataaatacatacaatttttcctttaaattaatgctaaactattgtttcaatgaagtgttatcgagtgcttactatgttcaaagcattagcctaggttttaatggagaaacaaagaccaggaacatctctgtcctcgcttaattcataatctagtgggtaagatgaacacataaataaaacccacaataacccaaaacctcttgaattatgctaaatatcagaaatgctattacaggttaatgatgtgctacaccaataggtgggaagaaaagttaattttctgttcagcaacagatcctgcttaaaagaaatatgttaaaataaattataattaagatgaagcctgtttctgtacttatcttgataaacctaacataaagataatatacactgtttattaaaacaaacaaaattattaaaacatatctccagaaatattttgcaacttaaaactttggtaatgatttaattatgacacttcatccgataatgcagtactcataatttttattaaatatacatgatccaataaccattagactctgaaagctcctttgaaactagaccttggctcagaaaaaaaaatacatattaggaatttaacaaaatgttttctgaaaaataacttttcacttctccttaagaaacgtccattactagaatgtgaaagacaaaacaaatattttcattttacagcataagaaagagcaataaccccagtaaattttttcatttccctcagtttcttcattagcagtttctttaccatgtgtaatttaaaaataggaaggtaacctaaggataacaactaatttaatcctgcatttttaaagctgagaaatctggtgctcagagggagtcacagctagtcagtggcagactggagacgtgaccaaactctggagtctcccttgagttcccttcctaggaggcagtggtgctctagggctcagtgtgtttctctgcttgtctttcttttttttttttttttgtcagcagttttaaatttgaatcttaatgtatctggaatgtggtcaaacattattaaatattttgaacggcactgacctgccattaccatatgatgatgttaccagctgagtgataattcagatttggcacatggttatgaggttaacatctcaagatacgacatgtaaactaaggtgtgttttatcccctgattatctccctcctccttctattataaaaccttttgaatggattatttttttttcttcgtactcttttcttaccttttaagttgactttattcaacttctagaacttgtttaagccctcttatttttcaatgaaaatggttttgtttacttatttttagtattattttatatttgggggtacatgtgcatgtttattacatggatatattatgtaatggtgagatttgagcttctagtgtacccatctacaatagtgagcattgtacccaataggtaatttttcaacccttataggtacttttcagtacctattatttctgtctttatgtttatgtgtacccattgtttagcttcacttataggtgagatcatgtggtatttgattttgcgtttgagatattccacttaggataatgactttcatttccatccatgttgctgcaaaggacatgattttcttttttatttctgtgtagtgttccatggggtatatataccacattttcttcatccagtaatcccttgaaggacaggttgattccatgactttggtgttgtgagtagcgctgtgataaacaaattagtgcaggtgtctttatgtatataatgattttttttttcctttgggtagatacacagtagtggagttgctgagtcaaatggaagttctctttttagttctttgagaaatctccatgccgtttcccatagaggttatgccaatttacattcccacctacaatgaaaagtatcccattttctctgcattcataccaacatctgttgctttttgactttttaataatagctgttctgactggtgtaatatgtattttattgtggttttaatttgcatttgtctaacaattagtgatgttgagcattttctcatttttattggctgcttgcatgtcttactttgagaaatgttggtttatgttctttgcctacttgttaacgggattatttgttttttcttgttgagttattttagttgcttggaaattctggatattactctttagtcagaggcataatttgcaaatattttctcctattctgtagattgtcagtttactctgctgattatttcttttgctgtgcagaagcattttagtttacttaagtcccatctgtctatttctgcttttgttgcttgtgctatcaaggtcttcatcgtaaattatttacctagtccaacacccagaagagtttttcctaggctttcttctaagatttttagtttcaggtcttaccattaagcccttaatccatcttggttaatttttgtgtatggtgagtaacaggggtcaacttttgttcttctgcatatggctagccaattttcccagcaccggtcaggcacggaggctcatacctgtaataccagcactttgggaagccaaagcaagaggattgcttgagcccaaaagttcaagaccagctcaggaaacacagtgaaaccctctctctacaaaaaattttaagaaattaggcaagcatgatgattcatgcctgtggtcccagctgcaaggggagctgagactagagaatcacttgagcctggtaggttgaggctgcagtgagctgtgttttccactgcactccagcctgggcaacagagtgagaccttcaaaaaaattccagcaccattaattgagaagggagtttttgccccattgtttatttttgttgactttgttgaagagcagttagctatagttatgtggctttatttctgggttctttattccatttcattgatctctgtctctttttgtaccaataccatgcagttttggtaactatagccttgaaatataattttaactcaaggaattatatgcctctagcttttttcttttttcttaaaatttctttggccatttgggcacatttttggttccatatgaattttaggattgttttcccaacttctgtgaaaaatggcattggtaattggatatgaatttaattgaatctgtagatttctttgggcagtgtggtcattttaatattgattcttgaaatctttgaggatgggatgtttatccatttgtttatatcatctatgatttctttcagcagtacttcgtagttctccttgtagagattattcacttccttggttaaatatattcctaggtattttattttattgtcagctattgtaaatgagattgagttttgaatttggttggtagcttgaatgttattagtgtacagaaatgctgctgatttttgtatgttgattttgtaccctgaaactttactgtagtcgtttatctagtcaggagtcctttggaggagtcttttgggtttctaggtataagttcatgttgtaagtgaagagagataatttcacttgccgttttccaatatgaatgccttttatttctttctcttacctgattgctctggttaggaattccagtactgtgttgaataggagaggtgaaagtgggcctttttgtctctttccagttcgtagggggaaagttttcaacctttccccattcggtctgatactggctgtgggtttgtgatacatggctgctaatattttgaggtattttctttccatgcctagtttgttgagagtttttatttatgagaggatgttggagtttatcaagtgattttttttatatctattgaggtggttgtatggtttttgtttctaatcttatttatgttgtgaatcacgttcattgatttgtgtatgctgaaccacccttgcatcgtgcagtagaagcaaattgatcaggatgaattatcttttccatgtgttgttagattctgtttgctagtattttggtgaggatttttgcatctgtgtttatcagggatatttttgttgttgttgttgttgttgttgtatccttccctgattttggcatcatggtgatactggatttgcagactgagttaggaaggaatgtttcctcctcaatttttttggaatagtttcagtaagattggtacccgttctttttggttgtaataattttattacaagttcaattttaatgctcattcttgctctttttaaggtttctattccttctttattctatctaggaaggcggtatgtttataagaatgtatccatttctttaagttttctagtttgtgcacatggaaatgttcatagtagtctttcatgatgttttgtatttccgtggtatcaactgcactgttatttttgtcatttttgattgcgcttatttgaattttgtctcttttatctgtagttaatctagcttgtagtctattgattttgcttatcctttcaaaaattaactttcaatttcattaatcttagtatcatttctttattctcaatcttatttaattttgatctgatctttgttactccttgtcttttcttagcttggttttggtttgttcttgttttctgttttcttgaggtgtgacattaaattattaatttgatatctttctttttggtgtagacatttaatgctgtaaattcttagtattgcttttgctgtatcccagaggttttgatatgttgtttctctatttttactcatttcaaaagatgttttgatatccactttaatttccttgttcacccaaaagtaattcaggagcaagttgtttaggttctgtgtacttttttgaattttaagagttcctcttggtgttgatttctcattttagttcaccctgcttcaataaggtacttgatatgattttgattttttaaaatttaccaagacttgctttattgccaggtatatggtcaattttgaaaactgttacacagatgacaaaaatgtttattctgcagttttggggtagaatgctttataaatgtccattaattagttccatttggtctaaagtgcagtttaaatccagaatttctttgttgattttctatctctctatgataatctatctggatatcccccttctacaaccacagctagtgctctcttgaaagcaccaccgcctggctggaggtcaaccaactcaatccattatagcaactcagaagagaacaaccctgctccaaagaaggagaaaacaatagctaattccactgccagtaacaccctggctaaccagaggtcctgagtctgactacgtgacaactttagtgctagcataattagcatttaagaaaaccagtgcactaaacatgaggacacaaaggcatgagaatagtataatggactctggagacttgggtaaaatcgtgggagtggggtgagggataaaatgctacccactgggtgcagtgtacactgtctggtgatgggtgcaccaaaatctcagaaatcaccactaaagaacttatccaaacatcgtaaccaaacatgacgtgttccccaaagaactattaaaattaaaaaagactaaatattgatttaacaaaaaaaaatccagtgagattagtgaagtgttgaaatctccccctaatattgtcttgctgtctcttttcttaagtttcgtaatatttgttttatgaatctgagtgcttgggtatagagtgcgtatgtatctaggatagttaaagcttgttgcattgaatgctttattgttttataatgccagtttagtatttttatactgttgtttgcttaaagtctgttttatctaatataataataggtactgctgtttgctttggttttccatttctgattattgccttgttgatgtttcttttgtatagtattttccaggtgttctctgtctttcttgtatatgatgtctatatctctagcaagatcaagtatttttttttcattattccttcaaatatatttttcaaatttctttttcttattatccctcaggaatgcctgtaagtcataggtttgatcacactacataatcctccaaggctttgttcattaaaaatattttttctctatttttgtatgactggctcatttcaaaagactggtcttcaagttcttaaattatttcttctgccttttctaatctattgtgaaagctttgaactgtattttgaaattcctatagtgaattttccatttacagaaattgttttttaaaaaacatatctgtctcatcctttatattatgaattgattcatttattattttgtgttggttttccactttctcttggatgtcttgtgctttcttatagtccatgttgtcaattctttatcatttcagaatttatattttggttgggatccattgatatacagcttgcatcatcattggagatattgaaacactttgtctttttgtactgctggagttcttgggctgactctatttcatctgaaaaagcagtcacctgtttttgaaattggtattgatttgataggacttttaaatttattattcttttctcccctgtggatatcactgtagggtatgttatatatgagcgtttggcattgtttctaggagctttcagagagccagtgttctgtttgagttccttggttattatcttgtacagtggctttctcaaattctggttgttgtggcaatgtatttggcgtatgaacccactcacctgctgtgggaatgagagtgtggatgtctcacaaagcttctttcatactctagcatgattcccttctgtcatcagattttttattttgtgttcccatttggtctccagttcagttgtaggcaataaagattgggtaaaccaatgatgagtgaaagcaccctccctgacccctgattggagtagagtagtgtgggaagttcatggtgagatgtgctgaggcccaggtgcgggaggagactacaccagcttgggtgcagacggacacatgatccacttctctatcatgctcctgtataagggcttgccatcttccattcacagagacactgtcctttatcttcagggcatgatgcaactgagttccatgggggtggggggatggtggggaggggtgtggcggggaacctatctggcagcagtaaaatggccaggggaagaacctcttcagtcagtccaaaacagatagatttgcagctggtctgccctccgatgcaaggacacttctgctgtgtgtagagagggagaggtgagccttgccctctgtgtgagcacaggcagcggacacacttttaatgaatgtgcagctattgtgaataccactgggaaggttgttttcaagtgcagtcatgccagcctccagagggaaaaaccttggctacatccatagcatggacaggggaagagggggtgaccctccttcacctccttttccaggcagccagtgctgcctatcctctgggacaaaacaatgctcccctcttttgaagacttggactttatctgtgtttcctttgtctcaggaggtgctttggcagcttgccctctcattttccataggaatggcacatgccatacactagatctccaggtatcccacagctctccgggacctactagtccctgtgtttgccaaagtcagagtgtgttctagggtgtgtttgtgggagatttagtgatgcagtaacataaaggctgagattccctggtcaaagcagtggcccagaatgggtacacaaccagtatggcacacactgcctcagttcaggctgcctcagttcaggcttgtgcagagtataaccacacgtgtgcaagcaggccatctggtgctctgcccccaagaagttctcaaactgccacagtgttgcccagacttgtgagggcagaggggctctctgacaatttggtactcagtaggctgttgcagggtgaaggggccaaagaattacttccacctaccctttttgagggactccaggttccttgcggatcagtctgccatattcttgctaccctccttttctgcaccacagatgcttcttgtgggttttccaactggttttggcactctgccctcagctttccagtagggccgtgattgttcacctatgatctcgtatctgatggaggagaacttgtatctgatctctgtagctagtgattttgaataaaaactacttttgaaaatagtcatgtaccacataaggacatttcagtcaagaatgggctgattatatgacactggtcccattagattataataccatagtttttctgaaacttttattatgattagatatgtttatatacataaatgccatttcttacaatatcctacagtattcagtaaagtaacatgcttgtagtaaagtacaggctggtagtctagttgcgacaggttataccatatagccatgatgtgtagtagtctatcccacctagatttatgtaagtacactctatgatgttcctagaatgataaaattgcctaatgacacatttgtcagaatgcatactcattgttaagtgatgcatgactgtatttataataaactttgacaaaaatacaagtttgtttggacaacattagagaatcaagacagtgctatcccttagaatattttgcgttgatagaaatgtcctaagacttatattgtccaatacagtagcccctagccccatgtgaatattgagtacttgaaatgtgcagtgaagagactaaatttttattttatttcaattaatttaaattaaaatagttgtctctgactagtacctaccgtagcagacaacaactggatagcgtatttctgaaaattagctgtggcactcatataatcagtaagtcaaggaagcaaaaaaatgacaaactaagagaaactaaagagacttatgttagtctttgtcactcactcagctctcattctcccctttcagtgctattttgatcattctttgtatattttgggtagatgtcctttgtcagatataggttttgcagttatgtcctcactgtcagtggcttgtctttttattcttttagcatggtatttttgtagtgcagaagtttttaattgtgataaagtgcaacttatttcttatttcatggatcatgcttttgttggtatatttacaaactcataatcaaaccaaaaatcatgatgattttaccttactttttgagaagatttttagttttgcatttttatattttagtttatgatgcattttgaattcatttggtaaaacatgtcagatctttatctaggtttattttcttttgcatatgtatgtccaagttctctagcaccatttgtgaaatgactatcttttttccattgaattcatattacttctttgtaaaaaatctgttgaatatatttacatgagtatatttggggttctatatttctttcttttacctatgtgtctcttctgcctaataccagagtgtgttgattattatagatttatagattattacagatttattatagattattatagatttatagattattatgattattatagaagtcaggtagtgtgagtcttactttttttctttaatgttgtgttcctttttgtgggcctttccatgtaatcatttttaaatttccagatgttttactgtaaattgataatttataattatatatatttatggggtacaatgtgatgttatgcttcataagttcaatgggatacgtaagtcaagctagttaacatattactctggtttggatatctctttcaaacctcatgttgaaatttgatccccagtgttttaggtgaggactaatggaaggtgttttggtcaagaatgcagatctgtcatgaatagattaatgtcttccattagagagtgagtgagttctcactctattagttcccaggacagctggttttttttgttttgttttgttttgtttttccatcttttgattcttctcttaccatgtgacctttgcacatgtctactcccctttgccttcgactttgagtggaagcagcctaaggcatcaccataagctgagcagatggtaacaccatgtatcttgtgcagcatacagaacatgaacctaataaacctcttttctttataaattattcatctttaggtatttctttataacaacatgaaatagattaagacaaatatctgttaactaaaacgcatttgttatgttaaaaaattgaaatagctgggcacagtggctcatgcctgtgatcccagcactttgggaggctgaggtgggcagatcacgaggtcagattgagaccatcctggccaacatggtgaaacctcgtctctattaaaaatacaaaaattagctgggcgtagtggcgcgtgcgtgtagtcccagctacttgggaggctgaggcaagagaatcacttgaacctaggaggtggaggttgcagtgagccgagatcatggaactgcactccagcttggcaacagagtgagactacatcacaaaaaaaaaaaaaaaagaaagaaaagaaatatactctcttatgaatttccaaatatgtaatactctataattaaccatatttatcatgaggtgcaatagatattttttaaaacccacatattccttctgttcatctgagattttctaccctttgaccatcaactccaattccctccacgctccaatttttttttcctgtaaaagcactctgttctctgcctctatgagttttatttctatagattccatatgttagagagaacatgtagtaattgtatatctatgcctggcttattttacttagcataatgttctccaatttcatgtagtcaaaaatgacaaaatttatttccttttaagcatgcatattttgtcattgggtatatataccacatttctttattcatttgtgtgttgttgtacacttgggttgattccatgacttgactattgttaatagtgctgcaacatacatgggggtgccgacattcctttgacaaattcaaatcttttggataaatacacagaagtgggattgcttgatcacttgtaattctattttttggttttttttttctttttttgaggaatctctgtaaagttttccataatagctgtaataatttacattcccaccaagagcgtacaagggttcccttttctccacaaccctgcaacacttgttatcttttaactttttggtagttgccaattctgaaaggtgtgagataatatcttattgtggttttaatttgcatttttcatgattaatgatattgagtattttttatatttctgtttgctatttttatttcttttttgtgagatgtcaattcaactttcttgcccatttttttgtttttgtgctgttgagttctttcaatttcttacatattttagatattaaatccttctcagatgtgtgccttgcacaaattaacagtgtgattttcacactgttaattgtcttctatgctgttcagtagcttttaaatgtgatgtaatcctatttgtctatttttatttggttgcctgtgcttttggggtcaaatccaagaaaaataattggccagctctttcttatgtaattattccgtgatttttttttcttcttttagttgaacaatttctggtcttatgtttaaatcttctatccattttagggtatgagttttgtatacagtattaggtaaggatccaatttcatttttctgcatgtggatattcagcttttccaacactatttattgaagaaacagtttctttccattgagtattcttggcatgtttattgaaaggcaatagatcatacgtgtgtgggttcatttctggtgttttaattatcatagctctgtggtatacagaagtttgtaattatgtagtacaataacttcagctttctttttttaactcatgattaccttggttatttgagggttttattggtttcctatgtaaattaggcttaattgtatttatgtgaaatatgatattagaattttgatagagatcgcattaagtgtttagatcactttgggtagtatgtgcattttaataatattaactcttccaattcatgaacatggaatatgttttcatatatttgtgtcatcaatgtctttcatcaaagtattttaagttttagtatactgatttttcctctccttaattatttcttgatttcttttttagatagtttgttcttagtgtctataaatgctactgatttttgcctgttgaatttgtatcctgtagctttacagtatttacatattatttctaacaatatttttggtggtcatttcctatacgtaagatcatgtcatcagcaaatatcaacaattttacttcttccttttctattcagatgacttttttttttctcttatcttattgctctggcaagggtttagagtactttgtttaatagaggtggtaagagtgagtattattgtcttgttccagatctcagaggaaggacttcaattattcaccattgaatataaatgttagctgtcagcttcttacatatgggcttcactgttgtgttgaaatgcatgtcttctatacctaatttagtgaggttttggtgatgaaagtttgttgaattttgtcaaatgctttttctacatttaatgaaataatcatatggtttttgttctttattctgttaacatatttattgatgtgtgtgggctgaaccatctttgcatcccatggataaatctcacataatcttggtggatgatacttttagtaagttgttgatttggtttacatttgttttgatgattatttttgcatctgtattcttcaagtatattagcctctaatttgtgcacatgtgtgtctgttttgtccttgttctggctttagtagcagacagttcttgcctcttaaaaagagtttggatgtgttcatttcttttcaatttttttggaagagtttgagaaagatagatattgtttcttctttaaatgtttcgtagaattcagcagtgaaggcatcatcaggttttctttgctggatgaactgattcaatctcatttgttattgatatgtttgcattttgtatgtcttcatgattttgtcttttgttgttgttgttgttgttttagtttttatttccaaaggtttgggggagcaggtgtggactagtgagggttctctagagggacagaactaataggatatatatatatatatatatatatatatatatatatatatatatatatatatatatatagagagagagagagagagagagagagagagagagagagagacagagagagagagagagagagagacagagagagagaggagtttcttaagtattaactcacatggtcacaaggtcccacaataggccgtctgcaagctgaggaagaaggagagccagtctgagtctcaaaattgaaaaactaggagtccgatgttcgagggcagaaagcatcgagcacaggagaaatatgtaggctgagagactaagccagtctagtcttttgacatttttctgctgattttatattctagctggcagctgataagatggtgcccaccctgattaagggtgggtctgccttctccagcccactgactcaaatgttaatctcctttggcaacaacctcacagacacacccaggatcaatactttgcatccttcaatccaatcaagtagacactcagtattaaccatcacaagtccacgccttctcaacgtgaactcatacacatctcctgaggttatacataatcttcaaataaagacaagagtaaggtcataattactcctaacataataccttgtacatccagaaatgcatcaatccggaacccaaatactattacataaagttagcaatacttaaatactgatataaagtcaataaatcttatgtcacatgataaaggagaaagaaaatgaaatgaagatattttcgtagtacaagtatacacaaacatgtttttaacaaaagaaggaggaaatactcatgacaattccagtccttgtttcttcagctggtcatgtgttcgtaggtggtattgatgactaccttctcctactacccattctgtattctatttgccttcagcaagtacctcagcaggtcatggtttttttcctggtggagtgacccaaactttcattcttgaagggtctgggacatttgtagtcctgcctggattgggctgttgtagtttcccattgaccttaatcacagggcatggtaatattaagagacaccctgatagatctcctatatatcatgcatattcttccttacctctgttgtagagtagtaaactgatttcatcttgatagtccgggtcaatcaccccagccaacactgtaactcccttcttggcctgttgacctaaaggtaggaggagcccaaagtgtccaggtgccaatgttaacttctagtttaatggaatcattgtgcttcctggtggcagcattcctccctctggaactaagacctctaggccagcaaaacgtaaggtcacgggagcaggaagcaaaaattttgctagtagatcactagaggtgatggtcagtggtcccacttccacttccaccccttgattcctggaccgatgaatcctggctttgggagaaagagcaccatatattggacgctgattcagagtatacacagccttctggagaactttgcctcagccctgcaaagtattgtcacctagttggcattgtaattgtgacttcaaaaggccattccactgttctataaatccaggtgcttcaggatgatgggaaacatggtaagaccagtgaattccttgagcatgagcccactgccacaattttttaggcataaagtgagtgccttggtcagaggcattgctgtgtggaataccatgatggtggataaggcattccatgtgtccagggatggtagccttggcagaagcattgcatgcaggataggcaaacccatatctggagtaagcatctattctagtgaggacaaacctctgccctttccatgatggaagaggtccaatataatcaacccaccaccaggtagctggctgatcaccccaagtaatggtgccatatggaaatctcagtgttggtctctgctgctggcaaattaggcactcagcagtcactgtagctaggtcagccttggtgagtggaagtccatgttgctgtgctgagcccacgtataacctcagtacctgccaccatggccactttgttcatgggcccattgggcgataacaggaatggctggggaaagaggctgagtggtgtccacagaacgggtcatcctattgacttgattattaaaatcctcctctgctgaggtcacccattggtgagcactcacatagcatacaaatatcttaacagtttttgatcacttggagaggtccatccacatccctcttccccaaatttctttgtcaccaattttcctatcatgcttcttccatgtccttgaccatccagccaaatcattaatgacagcccatgaatcagcatataattgtacatctggccatttatctttccatgctaagtgcataatcaggtgcactgcttgaagttctgcccactgggaagatttcccttcaccactgtccttcaggaatatcctagaaagaggctgtagtgttgcagctgttcactttcaggtggtgcctgcatatcgtgcagaaccatctgtgaagcatgtcctagttttctctttctctgtcaactgatcttagggaacttcccataaggccactggtgcaggcttggggagagaaggcagggtggccggagtacagaccatgggcatttgagccacttcctcatgtaacttccttgtgccttcaggacctgttcaagcctgatcacatatataccacttctatttaatgatggaatgctgctgcacacaacccactttatggctagatgggtcagaaagcacccagttcatgataggcagtacaggtggcatggtgccttgatgacccgtaggcaaacattcagtttccaccaaagcccagtaacaggtctagagctgtctctcaaaaggagaatagttatctgcagaagatggcatggccttgctctaaaatcctagaggactctgctctgatccacctatgggggcctgcaaaggctccagtaagcctccctatctgccactgacacctcaagcaccatgggatctgctggatgatatggcccaagtggcagagcagcttgcacagcagcctagatctgttgcggagccttctccgcctggattccactccaaactggcagcctttcgggtcacttgataaatggcccagagtaacaaagccaaatgacgaatgtgttgcctccaaaatacaaatagacccactgggcgttgtgcctctttcttgcttgtaggaggggccaaatgcagcaacttatctttcaccttaggaggaatatctcaacaggccccacaccactggacccctagaaattactgaggtagaaggtccctgaaattcagttggatttatttcccatcctctggcactcaaatgtctcaccaataagtctagtgtgtttgctgcttcttgctcactggatccaatcagcataatgtcatcaatgtaatggacaagtgtgatatcttgcagaagtgaagtgatcatggtctctctcaataagattatgacacaaagccagagagttgatatacccctgaggtaggacagtaaaggtgcattgctggccttgccagctgaaggccaattgcttctggtgggccttatggacaggaatggagaagaatgcatttgccaaatcagtgtctacataccaggtaccaggagatgtgttaatttgctcaagcaataaaaccacatctggtacaacagctgcaattggagtcaccacctggcttagcttatgataatccactgtcattctccaagagccgtctgtcttctgcacaggccaaataggagagttgaacggggatgtggtgggaatcaccactcctgcatcttttaagtccttgatggtggcactaatctccaccatccctccagagatgcaatattgttttttatttaccatttttctaggtagaggcagctctaatagcttccattttgcctttcccaccataatatccctcactctaccagttagggggccaatgtgggggttctgccagctgctaaatatgtccatgccaattatgcattctggcactggggaaatgaccacaggatgaattcagggacccactggacccactgcaagtcagatctgagctaaaactccattaattacctgatctccacaagtttctactttaaatggaggcccacaatgacgttttgtgtcctctggaatcaatgtcagctcagagccagtgtccagtagtccctgaaatgcctatcatttctctttcaccagaagtctccttggggaaggatggaagaaatattaacagcataaattgtcagtagtgtagtggggtccttccttaaggggaccgggactccccttcattcaaggggtactgggtctgtaaactggatcaagtctggaaattgattgaggggccatgtttctctgtttttataatccaaattggtcttttgtccatttgacctagaagttttctgcttatgtaaattaaggaggaatgcaataggcttcctattaattttaattctaggaacactgtgattaattagctaatgcccaaactctacacaagtcagagtatttttaatgctgctttgcctctgctgtttattacagtagctatgctcaccttgattttgatggttcagtgccaccacttggcttctgctgcctgggatccaattattcccactgtatttaaattttgtagttgagtgactgtggttcccaccgttagatctgacatatggagaagagcaattacagggttttttaaagatgcagatgctgccctcataaacttatttcacaaggcattggtcaagggtatgtcttctagacactcccagccgggatgagtatgtctaaagtgactaacccacttcatcatcccaatctccctaagtcttgggatctcttcctctacattaaaccaagggagatcagacattttcagctcactcagtgtgggacatattttaatccatattttagctaactaagcaaataaactattaggattttttatttttatctatttttattattattgttattattattatactttaagttttagggtacatgtgcacaatgtgcaggtttgttacatatgtatacatgtgccatgatggtgtgctgcacccattaactaactcatcatttatctatttatttttttttgagatagagtctccctctgacacccaggctagagtgcagtggcacaatcccagctcactgcaacttctgcctcccaggtttaagtgattctcctacctcagccccctgagtagctgggattacaggcacccaccatgacacatggctactttttgtatttttagtagagatgatgttttcccatatcggttagtctggtcttgaactcctgacctcaggtgatctgcccgtctcagcctcccaaagtgctgggattacaggtgtgagccaccatgcccggcctattagaatttatttttaacttcccgatctgcaacattaaatgcagagtccctacttagtgggcccaaatcaatcagttcagcctgatccaactcaatgttccatccatcattatctcacacccttaatattcattcccatgcttgttatccagatttctgcttatatatattagaaaactcaagcagttgttttcaagtgtagcatacctcctcatgggtcacactctgaaccttacctctaggagcccgctgggactctattctagttataggtctagaggcaaacaggtattagggttggcttgtgaagataatcaacattatcttgcctggcaactgcctcaggggaggccatgactgttgcctcaggcagaacagggtttatttccttagacaaaggtagaaaggctgatggcagcatgggtcggggaggggatgttgccactactagggatggggaagctgtttcttttggcaaaaaaggtgcatcagtgtttacaaagtcagcgttcccagcttcatcagggtcctcccacacatcctcattccaagttttagggtgccattcttttccaatcaatgccctcactttaacagtagaaacctggtgaggctgtgcatgcacctttcactgcaggtcagccacttgcatgataagagctcgtgtcctgttttccacaatttcagctctttctctataggaggtaagactctcactcagggcaatctaagcagatttgaggcttagtgtctgcttctgaaacagggagttgcaatccctgagttcataattttctttcatcactttgtccactgaactaggagcaaccaaccagcttcattgttttttggttctctacatacagtcaaagatattatgtgcagagtcactaaactccttgcctcacatgagctgtgaatctggaatgtcaaatgcatttagtttgtataactctccaaacagtttacaccaaggactatcagtgttctccatactattagaagtagagtccttagcattttggggtttaatcatattaagcagtcaacttcagaaacccccgaaccaatgaaagaacaccatccttaatattctgtttctctagaaccactcctggtaccaaaatctgtattagtcagtgttctctagaggaaaagaactaataagatagttagatagatataaaggggagtttattacgtattcactcacacactcgcaatgtcccacagtaggccagctgcaagctgaggagcaaggagagcctatccaagtcccaaaactgaagaactcagagtccgatgttcaagggcaggaagcatccagcatgggagaaaaatgtaagctgggaggctaggccagtttattcttttcacatttttctgcctgctttatattctagccacactggcaactgattagatggcacccaccgagattaagtttggttcacctttcccagcccactgactcaaatgttaatctcctttggcaacaccctcacagacacactcagcatcaatactttgcatccttcaatccaatcaagttgacactcagtcaacacttaatcatcacaaggtggtatttggttacatgaataagttatttagtggtgatttgtgagattttggtgcacccatctctggagcagtatacgctgaacccaatttgtagtcttttttccctcaccctcctctcaccctttaccctgcatctccaaagttcattgtatcattcttatgcctttgcatcttcatagcttagctccaacatatgagtgagaacatatgatatttggttttccattcccgagctacttcactcagaataagtctccagtttcatttaggttgctgcaaatgccgttaatttgttcctttttatgactgagtagtattccatcataaatagacacattgaccaatggaacagaatagagaacccagaaataaacccaaatatttacagccaactgatcctggacaaagcaaataaaaacataaagtgggggaaaggactccctgttcaaaaaatggtgctgggatcaatggcaagccacatgtaagagaaagaaactggatcattgtctgtcaccttatatgaaataaactcaaaatggatcaaggacttaaatctaagacctgaaactataatgtcttcatttaatcttctgaaatttgctgaggcttgttttgtttcataacatatgatttattttggggaatgttccctgcagtctttagaagaatttgtattctgttgttatctgttggttggaagattctatacatgtctgttagatccattttgtctacaatgttttttgaaccaattactcccttattaattttctgtttataagtagagtattgaaagtagggcattgaagtcccaccttgttatttaattgtgatctatctctcttttcagttcttttaatgtttgttgaatatatatttagcttttccaattttgggtgcggtgcatatatatttacaactgatataactttttgatgaattgacctcttatcattatattatgtccctctttgtcttttttttttttttacaattttttacttaaagtctattttttttttaagtataactatgctgtctatcttttgagattcacttgtgtggaatatcttttatattccttcactttcagttatgtgtgccctttatagtgaagtcaatctctttttagtaacaggtaggtattttttttaatccattcagtaactctatttctttttgttgagaaatgtaataaatttacattccaggtaattactgacgagtaaggacttactactgtcactttgttttctgattgttttgtaggttttttttttctttctctcttgcagtctttctttgtggttccatggttttctgtagtggttcatgctttaaatcatgtgtgtaattcctgctttgaatgcaggcattcatgctttgaattcattctactttttttgtttgtgctctactaaagatttttgcttttttattaccatgttgtttactagaacatcctgtacttattgcattctatttcagtctgataagaacttaaattttattgtatacaacaactctggactgttactcctcccttcacagtttatgtttttgatgccagaattggtaacatttttattatgtatcccttgataatttattttcgctatagttgttgttttgcattttaatgcccatactaggaataaaattgcattacacaccttacacacacatcattaaaatcctagagtactctgaaaatgttgttttacttataccattaggttttgtgcttttgtatgttattgttgcaatttaaatattaataactcccattaagattcctgtaaggcaggtctagtgatgttatactcccttagcttttgtttgtctacaaaagttcttatttccccatgactctgaaaagacagttttactggataaagtattcctcattcgcagttttcttttttcttcagcactttgaatatattattcaaatttctcttggcctgtagggtttcttctaagaaatatgttgacagttctattgccattcatttgtgtgaaatgtttgtcttgtttcttgctactctcagaatagtttctttgcttttgatagtttgattattatgtatcttgttgtagtcctctctgggttgaatttgactgagctctgtgcttcccctacctgggagtttacatctatccttagattagggaagtcttcaaccattatttctctaaatatgatttctggctgctcttctctttcttctcctcctgcaactcttattatgcaaagacttgttctagtgaaggtgtctgaatttttaagaggctttctttattcttttttattcttttgtctttttgctcctctgactggattatttcaaattgtctgttttccactcactgatcctttgatttgtttgttctattccgctgtttgagctttctgttgagtttttcagttctggtgtattttttatctctaggattcctatctgattcttttttattgattctatttctttgtcaaactaatcatttttgtgtattgttttccaaactttattacgtttttcatccatatatccttgtactttactgagctttttaaatgagcattattgtgacttctttttcagtcatttcaatgatatttatttcttttggatttactattgtagctttattgtacatttggagatgttatgactccctaattcctcataattcttgtttccttgcattgttgtctgtacatttgtggagacttccctctcttttgtttttaaggttttttgtttgtttgtttgtttttttgtcagggatagatcttaactatttaatatagcctgtgattctggaatggcactctggtaataaccctggcctggtagagcttgctgtcggttttccagttggcttggctgctactttagctgtgatgtcaggtggagcttctggttgggctctactatcaggcatagcttctgtctcaggactgcagtgtcctctggtcaggctggtcacagcatatattacctggctgggcaattctgctctttgcaatctgcagttgggcagggctgcaggctgggctttgagttaggtgcagctgctacttggagggacaaataggaccagagtctatgctcattagaactggaagactgagaatagttttcctgttaggttgaagccatggggtgagcttttggctaagttgagtggctgtttgactttccaggtcaaaccagtgtagcccctttatttctctggaatgtatggaggtagaagtctccctggctcagcaaggtcattgggtgggcttttgtgctgagtggagctactgcataacttcccaggtcaaatcagtttagcctttgtgctttttgtaaaatatacagaggtgggagtcttcctgtcttggtcaatccaagggcatggacactagctgcctagggacccaaggtaagttaaacttcccaccatatttttgaaggcaactaggtcagttttttaagtgcactgagaagttgacttgtaactctaatctggtgccacaactggcaggaaaacagagcaaccaccaagattcatgcgctagtcactatgacctgcacttccttcctttgtttctgtctgagtctgagtattcttgccattctgttttccctagtgttctccatgaggtgaatttagcatggacttcctggaaagaatgttggaattctagggaagctggatgactgcctgtcattttcttcttcctttgtagaaactgtgggtcaggaaaatcctctctgtctggtattgtgccgacttggggaagggaataaagtggtttagttgaactaagaccattcttcttacccttctaagtcagatttaattctgttctatggaacatatggatgtttcagacatatttccaagtattggaattttcagaaggttattgtggtctgtggaaagttgctaggtgaactttctgttgggggtggggaagtggaacttgagactttctattttgctatcttgctgatgccactatttatttagtcttttgtatcagtattaatgtatatacaatagcgtactgacattttgattggaattgtgttgaatttatagatcaagttgggagtaatttattccacagtgttgtcttctaatccatgaaaacactatttctaaatttatttggatgtttgatttgttttatctgaattttgtagtctaacatatatagattttatacatattatgtaacatttacacctaaatgtttaattttttggtgctattgtaaatttaattgttaaatattaagagtacatttactaaatgtttattgccatattttgagttttgtgtattgtgactttgctatagtcacaatactatagcaccaaatacacaatactatagcactatttgctatagtcatttattggtttcgggaattttttttttctattgtagatacattgtgattttcttcatagacaatatgtcatgtgcaagtaatgacaattttatttctttctttccaatccattaaactgatctttctctttcttgccttattggtctgagatccagtacaatgttgactagaagtggtaggagaggaattccttgccttgattccaatcttgtggaggaaaccttctagtcttttaatgttcattttgttggtttaggtttttgtaaacatttttattcaagtcgaggaatttctacaatagtaattcttgatttctattgtctgaaagattttatggtgaattgctgttggatttcgaaattttatgcattagttaataagttaatatgtgaatttttttggcctgcttatgtggtggatttcattcatgtttcaaatgttgaatcggccatacatacctagattaaatgtgtgctacatgtttatttattatattttttttgtgatggatagattgaaataatcttttttattataaataaatttaagtaatctaggataaaaaatagcttcaatttttattcaaattgggtttagattgctgttttagtaccattttgtcaaggatttctgtgtctatcttcataagaggtattggtccataatttttctttttgtactattttttctggtttggtattaaggtaatgctggcatcataaaatattttaggaagtatttcctctgcttcttctttctggaaaaattgtgaggaattggtattcttttttcttaactatttggtagaattcaccaatgaaactactgggcctggtgctttctttgttggaagtataattattgattcaacttctacaacaggtataggattattcaggttatgtatttatccttgtgtattttggtagttttgtgtgttttgatagttttgtgtgttttgatagtttgtgtatttcaagaagtttttttcattgtaactaagttataaacttgatagatgtagccttgttcatactatttctttattgtccttttgatgtttataacatcagtagaactaatgattttctcaaactacagatctaagtagtgcaagaaacactaacaggataaatactaaaagtgtacatttagtcacttcgtattcaaactgtggaaaactaaagacaaattgaaaatcttgaaggcatccaggggtggggggtaaatgaaaaggtacctcacctctacaggaacatggataagaaatacagcaactttctcaatgctaactatgtgaacaagaagagaatggaatggattattgaagtatagaaggaaaaatgaataatttcatatctaataaaattatctttcaaaactgaagaataaacatttttaaacaaaaagctgaaggaaattttttctagcagacttgtccataagaaattttgtaatctatagaaacttctgagatcaaggaacttggaaatgggactatggtgaacagaaacacagagatgcataggtatgctaccatgatgtcagcattgagaaagtatttttttgttcatgtggacatagtgtgtatttctataaagttatatctaaaactgttcaagtaatgtttccttgttgatgctactattatggttcagtctagggtgaccctcaaatatttgcaggatggggatcaagatgacaaaatagacactcctattatttgtctaaatatttcctatttataaaatcaatagaaaattattaaatatatattagacccttttaaaaaggcacactgaataacatggctacacactcaataacatggctaaaattagaatgaatgataatatcttgccctgtgaaaggtgtgtggagcagctggaactctgacacatttctagtgaaaaagtgccttagagaacggtttgtcatttcttataaagttaagaaatgtactaccatttaatccagaaaatgactattgatactctcaaaatatagatgactcttaaaaaacactatgctgagggaagggaatcaggcacaaaaggctgtataattctatgtgtacaaatgcgagaagaaaaaaatataacttatagtgacaaaaggcatatatcagcaggtctgagaatttgcgtgggcttcacacagaaggagcacaaggattcctttagagtacaatgcatattttctacattttaattggagcagtgtttacatgggtatatacatttgtctaaactcattgaactgcaaacaaaaaatattttttattttattgcatttgaataatactttaaataaaggtagtttgaaaaaatgtttcttaactaagagggccaagaattagcattaaattagtgacagatctgggttttatattttcccctacattgcttgaaggtgcacataaatagaatctacatcattatattttaaaagagatttaatcattcagatgagaccaatctggtttccatggatgataaggaagctgtatatctgttatacagatgtgattaaaaaaagaagttaaaaagagagagatatgtccttaggtttctagccaaaaggaatatgttcatagtctttgaacaatggattcagaatttgaatcgagtatatttcctattttatattaaattactctgatgtagcaatgtttgctgttttatattttgttatagatctgcgtacaacaaataatattgcaaataaagccagtattaagtggacttcatttcctacagaaataattatagttattaaaaaatgacttcttttcattagatgagatattttgattttttgatgcctagaccacctgttttctattctaaccaagaaaagtcatggaattagaaagtagtaaaatatatacactattcttgtaatattacatacctctcacttgtagggaaagtttaattaattttaatagatatggattctatgatttaatatgaaaaataatcagtttggtattagagacattttaaatcaatgaccatgaggttaagttaaatcgattaagaatatattgtgctctgaaaattcttcaatgaaatgtgatgcccttaaattaattttaaatgtataccatagttttgattagatgagattctgaattgagttttagattgctgtagaacaaataatgaaagtaactacatcaaaaggaatactacataagcctttctggagagattttgaacatttagtggtaaatattaataacaaactctgagggtaggctgcctgggtttcattagaatgtcacttagtaactgggaaagcttggaagatgagtgagcacaaggggctttctcttttatcacactgagatgattataaataatgcccatcccatagacttgttatgtagcttaaatgagttaatatatggaacattttagaacagtgcctagcacatgagcacagcataagtgttacctctttcgttattgtatatgttggatgggaacacaactggtcattgaaattttctagtggtactagcgagaaaggatatcagagaagaaaatgaaaacttttggtaggtgaggtagagctatggaatatgttaatatttaggctaagatgcaagaaataaaggtaaaggttttgtcagttttcttactagcatactccaagaatcacaaatagaggcaggcaaatagtagtcaacaaatacttgttgaattgaattgatctttcccaaaacttaatgttcagttatatctgaatagttataattaaatgtgtaatttacataaaaatagaacttggaactatttactgaaaggctactgcaaacttaaaaggaaattatgaattagataatctgcatgtacaaaaacgcaaaaaagtggagcaaagaggaggtgacaataagtcattctcattagatgggaaaaaatagaaagggatggaaaaactctaaggaaaaagattttttgtcaatcttaatgaattaactgttaaacttgacgaagtttggtttcatcttccctgtttcctttttgtaatgtgaatcactaaaagatgaccagtaagaatggaggttggtaaataactacaggaaaactaaattttataactgtgctttggacccccactcatagcttgctttaaagtcccaggaaaaaatctttttataagagtagaatgccttcatttaatgacctcagattctttcttacaaagggtacaatctaccttctgtaatacctcagcctggggatccatgactgtttttcagtgggtgaatatccattcaggagggagcacatgaggtctgttaatagccaaaacaatagtaagttgctactatcatgtggttctgtttagttgggtgtggttactgaagacacaaagccaatttattgcatcactctcccttccctgctctttcatcaatctactttttcccaagaccacataattttacttttggaattatcataaatgattactaaaatcatggagatgaatttgcaagactgaattgcaaggtaaactcaactttattttgtaactaaaggacagctagggtaaaaaaaaaatactggtgccaaacaattctatattcaaaacatgtttgtgcattagaaataaattaatgggccaggcgcggttgctcacgcctgtaatcccagcactttggaaggccgaggcgggcagatcacgaggtcaggggatggagaccatcctggctaacatggtgaaaccccgtctctactaaaaatacaaaaaatcagctgggcgtggtggtgggcgccggtagtcccagccaccagggaggctgaggcaggagaatggcgtgaacccgggaggcggagcttgcagtgagccgagatcgcgccattgcactccagcccggacgacagagcgagactccgtctcaaaaaaacaaaaaaaaaaaacaaaaaaaagaaagaaaagaagaaataaattaaagactggtaaatccacaatcttgagattttgtgattttctaattctgtaagatgtatatgtatgtggtttttgaagaatgcaaggtaatgtgggcttaacatgcaatgcatgtaccaatggaggttgacttttttttattcacttgggggtctcccatatgggagtgcatgaaataccacagtacatgggaaaaaagaggccagagtgaagaaatagcgatatgaggcaaaaaaacaatatctgagggacaataatgtttttattatgctgcaatggaataagaacccatatttgatcaataagcaatcttaaaggtcatttctaaaagaatactcagctgcagcttaaaagataatttttaattactatttttacgtctctggactataaaatttaaaaaaaagtttcatattagtttagtgatgcaaggagaaaatattaaccgaaaatttaacaatataatgatatatattagagttttccctccccagtagcatgaataaagagccactaagcataaattgcaatggtacctaatgggtagtattaacccataatataaatagatattaaagctgttttaaaaagtgaccactgatacgtatttctgtagagatcttaactgatttctagacgttggaaggctactgtgccataataaactacttttttcttgcttgaataaattcacactaaacattcctcagaaggttcatagttatcttgaaagtcaaacattattgcagaatcttcagaagtaaattaaaaccacattgattttgtttaaagtagcacaggatttaaactagcagtgtttatgtaaggaaaattaagtacctccataagtagttgtgaagaggtgaagaggaaatatcaaatattataaaacaaaaaaaggagagtcaataaagatattttagaccttctaaaaatataggaagaagtttgggtatgtgtgtgtagatatggatatatatggtcatacatatagtcatatatatatccatatccacacacacacgtgtgtgtgtgtggatatggatatatgtgtatatgtgcatatatgtatatgggtatatatatccatatacacacacagaaacttttagatttgcatatatttctgcatacatatgcagaaatataaacctgcattcatatatgtatatacataaacatatgatatgtttattgcatataatcaggtaaaattttaaggattttaagaggaaactataaatagggcaagtttattacttatccttagagcactgtgttatttcatattggtttacaattctataatgtaatcttttctacaaaagtaagtacacacgatatgcccttgaccttatgatgtaaccgaaattattttattaaagcaaggcttacataaaaaaggccagggtatgtttgacaatgttctatataggtctgatgagttgtgagaaagagtatgttcatttaaaggtgtacctactggtaatttagctttgtgttgatgtttataacagcaattaagttttggaactagcatatttctttggcatactcagtaaacacttattaaataagtgttgacttattgttttgaattttttagttcctagaatatttaaatacttgaaaaaggatcaggaatagtatatgaccaatttcttaatttttaatggcatgcttgcattatttagttagcacattcaatttaattattttgattattaaagtaggttttccttcttatggtgtattattagtatcctggttctttttattagtattaactaacagaaaatgtccagaggcaatgaaaaacgcaaaacccagtgtaaattaataatgaacagcaagatttataatgattgtgagtaaatacaaagatcagcagctggtttatacagatggtcaataaaatgttggaatgtccaaaacataaacataaggggtgatggtaggaggcgggtagtgattagatatgtgatcactgaggttaactgttagttttggtagaacatggagcttttttttcttccactagaaatttccttcatgaaaaaaattatcaaaatgctccaattcaaattacaatgcctcttacagcatgtatacctcagtttattttgatagcctgaaatggctgctagagcatctgaaaaatatctgatttaaaaatcaagtaatcatttaggtcataagacatttaggtccattatttgacagctaaattgaataattgatataatttcatatttctgaatttactggtaaaatatgtgggcttcctctcagaattacatctagtcatttggaaatgcaaatcttacaaatatttattagccttattttattgtttttttagcatcacagagatcagtgatattttaaccctacctcaagcaatatattctgattaatatataaaattaaacaatcaaattgtacttttaggattccactatatgtgcctcaccatcctaaactaccttttatggtttttgtatccccgccatcccaattaccacacacaccagagtacacgcatagatacagtaccttagcaaaccatattctatgaaaactgacaaagtgattatcaggaaagaaagcaaagtatgctggtcatttgaactttatccctattttggccctcagaaatgtcatgcagttaattttttcttcttcttgatattgtgccagtaataataatcagtaagaaagtcaaccccatgcccagcatgaataggtgagtactaaaataaaataatacctatataacaatcaatgcaatgtaacagcgaaatgtcttgagacatgtaaaaatgtgtgttatcatcactttacctatagcaattttcaaagtatggggtttgcaacccaggaaatgtggaagatgcttcactgaagtgggaaaaatgaaacacttttattttatttttatatccttatatattatatataatacgtaaagatacacatcatctttatatttatctttatattttaccttttaattttctatttttgagttaaagtgatacctatgttaattcccagcaaacatgattcattacaaattcatactcaaacatttttaattgattaatgaacatggggcctgttgcgagaggactgttaatgtactcctccatgagatctcctgatcatcaactttccaatcatgttctttgcagttcccttaccagctggcgaacctgttagctactgctcatggtttagttcaggttcctacctcaagccatctctcccttcacacagtgctcagtcaaatttcccctctaaatttctgcctgatggaacgatttcctttcactcactgacttgcaggaccatgcatcagtagggttataaagaagcaactgctagcagttgctagcatatcggtgaattcttatttaatctaagcttgcaatttttcttcctttattaactggtcataaggtactccctgtgaaattatagttgtggttgagagagccaaccttagcaaccccacagagaagaactatggaaataaatgccttgacctcattcatcttctgtctcctaatactccatcattgccttaccaaccaggagtcaaagggaaagggaccctggctggtatggacatagaggtcagcaacccgaagcagagagctggagatggtgcagtcaggcctgtggagccaaataaatagcattcagcacaaccgccctcaacaaagtttcacagtccagcattagatttaattttataaattaaaatactttagagtatttgaggtgatccatttttctcttcacacttagtccagtattattttattgataattcgtaattgcaaattttgtgaaagatatatatattttttacttccaaaaaggacttgttagagcctgctaatacttgcctcatgctttctgtgactaaattaatgtttggagctctgttagatattttatgaaggtttataataaataaaatgttacatccagaaattattttaaaaatatatgtccacttcctaactagatgcatagtcaatgaatgcagtactcttttctttatgacaaaagtgagtatatttttcaaacatgatgaatccagcatgctgctcaaagcttactattttctatctgcggaataactcacaatgaatattggattatgtaaacagcttctgtaaaatggcccttgttttacttgagatgtcctcttccaaagggcttctcaaaacatctggcagccagattggtgcttttgtttccaaagaattcatggttatttcaaaaaaaaattttttttggcaaaatgggaagaatggggaagataaggatatttcctgtataaagctgaaactaaggccattactggagccattgcaagataagggccttttaaatattttttattgaggaagctcattcttaatacagaagaaaataatttcatatttcagcataattttattatcttagtgaacactttaaaagttgggtcaatggtttccaggaaacatttgtgactgtaacatgtgccaaacaacctcttattgtatataagaagcgtatgagcttaatgtgtattagtagaatatattataaggatgattgtgaaaggattggcaaacatttttatagtaatataggagtatgctttttcctaaaaaggaaacaaggaccttgctacttattttttctcagctactaaatattttccttttctgtaaattgtaatgaatttcctgtgaggaacttatatcctagaacaaatcgtattcctttataggtgctcctctgcccgcttctcatcttatgtccattaagaaactgtctcttcatggaactctgatcctttctttttcattccccaacatctactgactccactttgtacctgtcactataaaagccaggttatattcattttcactgaagccagatttttcgttaatacctagctaaaattaccctagtgggtgtattagtcagggttctttagaaggacagcgttaataggatagatgcatatataaaaagggagtttattaaggaatattgattcacgtgatcagaaggtgaagtcccacaataggctgtctgtaagctgaggagcaaggaagccagtccaagtcccaaaacctcaaaagtagggaagccaacagtgcagccttcagtctgtggccaaaggcctgagagcctcttgcaaaccagtgatgtaagtccaagagcccaaaagctgaagagcttggagtaccatgttcgagggcagaaagcatccagtacaggagaaagatgaaggctagaagactcagccagtatagtccttccacatttctctgcctgcttttacctaaccacgctggcagctgattaaattgtgcccacccagattgagggtgggtctgcctttcccagtccacggattcaaaggttaatctcctttggccacaccctcacagacacacccaggaacaataatttgcatccttcatccaaacaaatcaagttgacactcaatattaaccatcatagtaggtaatgtactgatttagaaaatatagataatgcaaatgaaagatgtaaaaggccctttaattaaatgaaccactgctaatcttcattgctgatatatgcatatacttcatttaacttgtttttccaaaaataggcttattttataacattgttttataatcctttttttttacttagtataacatgaacatctcccacatcattaaatattcttctatgcatcattttaatcactgcatagttttcttatatgaatgcaacacaatttatgcagtactgtatataagatatttgtgggggtgatgatatgtacacttataatgggatccatgcacaaacacacatgcatatacaagctactttaatcatgtatgcagggctgggcacagtagctcatgcctgtaattccagcactttgggagactgaggcaggtgggtcacctgaggtcaggagttcaagaccaagctggccaacttggtgaaacatgaaaaaataacatgaaaaaataaaaaaaaaaattagctgggcgtgcttgtgcacacctgtaatcccagctacttgggagactaaggcagaagaattgcttgaaccagggaggcagagcttgcagtgggccaagatcacgccatggcactccagcctgggtgacagggcaagactctgtctcaaaaaaaaaaaaaaaatcatgtatgcaggtaaatctttggacaaatctatatatgttttagaatatatttttaaaaggaatttgtgagtcataagttacaagctatgattcacttgcttgtatagaatagtatgggaaggtgtgatgtgggcatccactgtagtgcctattggctttggcatataaccttccatctaaactaaacggtgaaattatttaaatatcttatttaggaagagattgtgagcaagaaaggcagaataagtgatccatgattgtacagcaaatagctgacaatatttaataagccccagtttgtgttgaggtattgttgagactcctttgtagtagttatacaaaatattatttttattaaaagttactattggggcattgaaataaattaatcatgggctttttaaatttaaatggtgatttgctaaatctctacttatgatctaatttgtgatctaattaaacccattaagtccatagtgtccacacattttcattgtgagttgctatgattaaagatttttgagcttgtattaacacatatcaatttatttataatgtctatacatatagtaatctcaactcaattcatctaactttttttcagtaacataacagaccattttatatatatatatatatatatatatatatatatatatatatatatatatatctgagatggggaaaacccacgttaaaaacctctattctaattacttttttatcagtcttttgataatagaactagattgtctacaaattgccttctactttaaaaaaattattcactgattgaatgcacagtggcaagtactgggatgagccaaaattgatgcacaatgcttcggggagtttcatagactaacggaggaatgaaataattatattaataaaaataacactgacaagtataacaaatagacccaaaattctaatggtttagcaaaataaagttgttgttttgttttgtttttcatgtaaattttgcaatggatatttctcatgagcaaatggctctcttccaagcagtgattcagacatctaggttactgttggtagtgtcgactgctgttttccacacatggcttccaaagttgctacagcaggggaaagtacatggagaaccacacacgggaagtttttatgagcctggcttgaattggcacatatcatttctattctcggttaaggaccacacctaactgcagggcaggctggaaaatgttgcatagctatgtgtccaagaggaacaacaactacattagttcaatagttagaatctgtgtgataacatgcaaaaaatggaattgcaacattatgaaaagtataatggaatgatgtaaaagagctataaaattatgaaagagagttatcttacctgaaagttgaaattggtcttcagagatgaacaaggattatttgagtgatcagaggttgaaggaactttctggcaaaagaaatatacagaaagtcaaagagatgagaaaaggaataattctaatacagcatggttaattttcaattcacccattaaatttccactactttttcagaaggtattttcaggcaaatttacaaagatgtatacataaggaagaatattaattgcattgctgtttataatagatgtgattgaaaccaacataaatattcaaagaaaaagcattggttaaataaatgatggtatatccaaactttggaatattttgcacccattagaaaataagtatggattcacatatttatttggaaaggtttccacaaatgttttttaaatgataaaaattagcatgtacaggctgcgcatggtggctaacgcctgtaatcccgacagtctgggaggcctaggtggaaagatcacctggggtcaggagttcgagacccgcctggccaacatggcaaaacccagtgtctaataaaaatacaaaaattagctggtgacgggcacctgtaattccagctactgaagaggctgaggcacaagaatcgcttgaacccaggaggtggaggttgcagtgagctgagatcgcaccactgcactccagcctgggtaacaaagggagactccgtctcaaaaaacaaacaaacaacaaattggcatgtacaataatgttgaatgaaattataaaattcagcatatatgaatggtcctattttaaatacatatgtatgtttatgtacagattattgctgactgttcattcaagcagtagtttacttgatatttcactgtttttctatagtggcttcctcctttgctttcttccttcctgcctgcctgccttcctgcctaccttcatccttgtaaatgagcatgcattatttttatcataaaaataatatattttgagtaaaaaaaaatgttggtgatcagtgttctcttgtttctgtggataatctctcttagctagctgatgtaaaatgctaccttattgattatctaatagatgacacctttctgagaagtagtagctaatatatgctagacttgatgcagccggggcttgctatttacaactttctacataagaaatgaaaaacaaatcttactgtcagatgtgtcagatttataaaagttgtatatagtttattttcaaagggatgctaaatgaattgctacttgtcatacattaaatagaataaatttagttgtttaatttataggttaactatcatattgatatgtgaagtctatttttgtttctaagagaaatgggccaaagcaagtatatactgaatccccttattttattaagaattaaccctgagccacgtgtgatggtgggttcttgtagtgtcagctactcaaggaggctaaggagggaggatcccttgagcccagaagttcaaggttgtagtgagctgtgaccgtgaaactacacttcagtctaggtgacatagagaaaaccccatctcttttaaaacaatgaaaaaagcaattactcaaataattatccttgataaactagagcctttggactggcaaaagagcatgatctgggtaatggtgagtggagggtaaagtggtttttgtggtggggggtggtggaaaaaccagtatggttttcttatcttctgagtcatctataaacagataattgattgacaagaccaaaagcattgttttagggaaactgatttattggtagcagagtatgaatattcaaatatgagagggactaaaagtcagtgtttctaatttattacaattgtaaaattgaaagtaatgaaagtgaaagatctacaatgccaatgaaaagaaagattttaaaggaaaatatacagaaagtaacaactgagtagatctaagactagaaatacaatttgaaagatttttttgacaagcaaggcatatgggatattattcagattttgattcaatgttatgcttgtaccattattcatcacatattactatgttctctaacagaataaaattattactttaaaatcaatcaacttgaaatgttttttgttgtttgtttttgcttcaagctttttcctagatatagactagttcatttctcttttttcaaagagacactgcccactaataaaggggtaattctgcaaataagaaaatgttcacaatgtaatatacataagcaaataatgcaattgataaatagtgttctttttggtagatttatcagttgttttgtttataatatgatcatcttctttaacactgggaattctaagattaaaataaatgtaaattaaattttttaagtaggttctgtgttagagaaaatgaaaggtataaaatgattctggttttatcatatttctaaaagctttataatgtcattttgagtcaaactaattatttttttaaataatttcactatataattaggaagaaaatagctcatagcataataaattaatctctttttgaagtctacgccagctttggtatttgaacatttcatccatattcaaatcaacaataaaaaaaccacaatgtagatttgcttgccttctgcattacatttgcctattagagtagataaatagcacacatatttagatgacaagtggttttttttttcctctgactatggggaagcatgatattttgtgagtacatgagtctctttgtgtgtgtgctatgtaaaggaaatcaacaggtgagaaaaatgtatagaaactgatatttaaaggtgcttaagaccagtgataagtcacaacacccaactgcttattctttcccatttgttatttatgctatttgaagaattagaaaagtgttttcttctggtaagatgccttcctccaggtaaaagccagaaaaagtaaaaggctcgttccccactataactacttagcattctttttgcttgagcaaagtgaaaaacaccaataggcctgcttatacacaggcaaaacacacacacacacacacacacacattttaaaaatgtcaaatatatattcattagaagctgtaacagaagaatgtatttaactctggggagaagacgcttaacctgatattctttaagttgttacctattctccactaagaaactgagaataattaggagaatgactacatgttgttgcaagtagtcctaggtatacggacactgtttatgaccattttaatttcattgattatgataccaaaacatggcacaattactcctgctaccactgacaaaactataacttacataatgtgaaaataaaactgtcatgcctttgaatatattgcaaatatcaaatacttctgtgtgctttaaattgaccttcatagcttaaggtgttagagttgagcccatgtcttttccacagagcgaaattttaatcctatctgcttcctagtcttggaagcattgtgttgattatggtgactttctctgcagcatgtctttttatcagtttacagacggtgaaagggatcagaacatgcatccccaaatatgccactttgtcatatgggttattttaagctgcaggctctttcttaagaaagagcacatgcaggaagctgtttctgatctccctgtttctgcctaaaagaaggtcacaaagtttcccatgatacaaatccccccaccccttcccactgtattagaaagcaaaaattgttctcgtcaccagaagttatgagtcaacactggaatggacctatgcaaacaagcttactaaaataaccctaatctcctcatagttttccccatacatttcctagttacaaacccacaatttactgcccctagctccctacctaaatctcctttgtattatcacttactgacaatttattattctttgtttaaagtgatatataagcttttgggcctaaaaggttctttgaccttcattttccttctgaagactcctgtgtacacataaaaatacatttgtatgctcttttcctattaatctgtattatgccagtttaattcttatatcaccacagaatgtaagaggataaagaaggttttgttcccctacaaagatattgtaaacaactgtaaacagggaatttctttcttaatttccaaaaattatttttaaaaatgtaccccaaattatttaaccattcaaaagaatcacaaattttcaaaatgttaagaatcagaatattttttataccagggaaaaagtatctcttttttatggaattaaagttacagtccaagatatgttaaaaaaaaaaaaaaaacctaaactgaatatttatggttaataggagcgcccatgtcacctgtttatgttcttatttcagaattagaaagactcacaaagaagccacatataaattcatttaatactttatgtagactaaaaaatttttttaatcttacaaatgaaagataccttaatgtcattgtctcaccgacatcacaaattcatccaaagccaaatccaataacgtcatctgagtttagggatattacatatactaacacctaaagaaaattatttttattggaattttatttcttaaatttagaaaaatacaccttctcataaaatttctgccattgtttctatttttgctttttaaagtgaatgataatctttgtaaactttattttgatgacaactttttaaatagtttgaaattgaatacatatttttttctatattcaatgtttccagttctaactatttttatatatgtgagaggatttcaaggccaatcacttttttttacccatatctaaaggtccttagagatgcctattctcttatatggtttgactcatgccattacaaagtcatcaactggatggtcaactgtgtattcatgctaataataccagttttgctgttttgtggctatgatggttggctcagagcaaaatttgctggatgtgttctatcctagtttttaccatattcatacattattttagaatttatgtttttaatgaaatgttctaacttaaaaattattttcatatgcattatagtccttattttttttcagtatttcaaggtatgctgtgcctaaatatgtgccttttaatttatatggaaattaaactcagtaagattaatgtgttaggaactataatatagcagaacattggaagagtcgagacattggaagagtcgagaccagaaccacattcctttcactttaacctaatttaatatcactctgaagagtaacttcaggatgcatttgggccaactggcactttgtcttattactatatattagcatgcatacaggtatgtgtaggcaacacacacacacacacacacacacacacacaccccttgaaacgtatactttagatctagaagggactttagtgtagtgataacttgggagaagtggcgagaaaattagcctatatatcaaatcctgcgttctcttcacgaatattcaagcccagaatattattgtgaagtttcaattatagagcacatagtatccaaatttcaacttgacatttgaagttatgtgtcaccactatgaagcttcttttgacacaattcaaaatgtttagttttgtttgcctttataaagatgtaatggcagtagatatgtgaaatatcaaaacatttaattggatgtgaaaataaattaatcttagtattctttaaagttcttttattttgcattattttgtctgcctagtgttcaacttcagttttctctaatagtgtatgaaatatatgacagaagttttaagattgggtattttgtacatttagaattattgtcttaatgtttagtcatcatataatttatctaaacttggaagataatacgcagaattgatgtttttctttagcagagtgtgtggtttataatcagtaaaatcttgatcattatattataaaacctgtatgtaaataatatgcttcagaatctaatcagacacacaagtttatttattcagttcattatctgtgtgtttgtatgtatgtctgtatctctgtatgtcttacagctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaagggtaagtttgcatttgttatataatcttttatattcataatcaccatatttcagaatctcagaacttgagctaactcagattatatcaattctagcaatgtgtggttctgagtacctatcacatagcaggaatttattgtgcatgcatatgctgaaaaaggcgaactattttcttccctggcaaagaaaaatacgttacttgcaaagatgctgcaaaatactcaggccaaacaggtttttctatgtgagatgttttttgttgttgtcattttgttgtgctttctttatcgtaccagattcagagcaaatatgctctttagtagattacagtcgtatattgcttaacactgcagaaatgttctggaaaatatgtcattaggcaattttgtcattgtgtaagcatcataggtgtacttacacaaacctatatggtatagactactacatttctaggttatataatgtagcctattgtttctaggctgtaactctgtacagcattttactgtactgaacactagagataaatgtaacattatgttaagtatttttgtatctaaacatagaaaaggtatagtaaaaacacggtgtaacagataaaaatttgtatacttgtataggtcatgtaacatgaatggagcttgcaggactgaaagttgctctgggtgagtcagtgagtgtgtagtgaatgtgaaggcttagggcattactgtacgctacttgtagactttataaacactatacacttaggttatactaaatttctttttaaaatttctttcttcagtaatgaattaaccttacattactgtgatatttttacttcataaagtcttgaatttttttcacttttaaactgtttagtattaatacttaccttaaaacacaagcatactatacagctgtaaaaaatattttctttctttatatccttattctattagtttttttccatttttaatgtgattttcaattttttcttttaaaaacgaagacacaaacatacacattagcctaggtctattcggggtcaggatcatcaaacatcactaggcaataggaatctttctgattcattataatcttatgagactctcatcatatatgtgatctgtcattgggtaatgcatggctgtatttgccttactgcataaaaaggtccatatactttgcttataaaaagtatacctgcattgcttttccagcacaaaaatagctcattgtctatatgactctttcaccctataaaagtggtttattatggtttccagcaatttatactgctgtttataattagaatgcttaattatcagctatggaagaaatatgcacttggaaataatattgcacgaaaaatgatgttgaaaaattcaacttttatgtgattaactgtaagctatgctctagatagttgaacatattttaaacagatgtaataaaatgaaagtatttagtggcagaattgtaattctaatatatggtcctcgtaaaacaaactcttggcattaataaaagatgtgtcttgagattttagaaaatctccaggtttacaaatatactgcaggacacacttccatgtaaatagaaattgttcttttaagcacttagtgatttttctctacatgcaatagaacataattaatgcaaataaaatttgccacctctagtgggctacattacactactgtgtcatgatattagcatcatatttactaactcttatttttttctttctgaattacttcatataatatgaaaaccttggctgggcttggtggctcatgcctgtaatcctagcactttaggaggccaaggcaggcggatcaccttaggtcaggagtttgagagcagcctgaccaatatggtaaaaccccatctccactaaaaatacaaaattagccaggcgtggtgttgcatgcctgtaatcccagctactcaggaggctgaggcaggagaattgcttgaacctgagaggcagaagttggagtgagccgagattttgccattgcactccagcctgggcaacaagagcgaaactctgtctcaaaaaaaaaaaaaaaaaaaaaaaagaaaggaaaagaaaaaagaaaaccctgttgagattccagggcttgtaattgtcagaggtttatttggtatcttagcaactgctttgtgacaaccattgtatacttttgaaatgtctctctcaacaaaatcacaagtaattacatattgtggacatttttggcccctggggaatagttcaacatttaatattaaatttgtgcattgcaaattattatgtaaaaataattttacatgtagtcctgtgcatatgtgtgtgtgtgtgtgtatatatatatatatatttgtttgtatatagatacatttaaaagtacatacaataagcatatacaaaaaatatatacaataaacagtcttcgaagcaattttgagcattttagatgctaagtttataatgtttaaacattgcatttattactttgttttatatgctgtagtatgctgtagtgcaatggtccccaaccttttggcactggggaccagttttgtggaagacaatttttttacacatttggaggtggtggattgggggttgggggtgatttcaagacgaaactgttctaactcagttgatcaggcattagattctcataaggagcacacagcctagatccttcgcatgcgcagttcacaatagggtttgtgctcttatgaaaatctaatgcagtggctgatctgacaggacactgagttcaggtgataatgcttgctctcaggcagctcacctcctgctgtgtggctgggttcctataacaggccaggaccagtactggttttcagccccaggaacctctgctgtagtgtgataaaatgagtggctatgatacttatatattccagaaaactaggtaaacactatttcaagtttttaaaaaatctcgactttcaactgtcagaatacaaataaatcagaaccatgaattaaaaaaaaaataagtcttcactgagctaatgtttaaaatattcatagccagtgattttttttttttcttttaagaatctctgccaggcacggtggctcacacctgtaatcccagcactttgggtgggaggctgaggcgggcagatcacctgaagtcacgggtttgagaccaacctggccaacatggtgaaaccccgtctctactacaaatacaaaaattagccaggtgtggtggcccatgcctgtaatcccagctactcaggaggctgaggcaggagaatcacttgaacccaggaggcagaggttgcagtgagccgtgattgtgccactgcactccagcctgggtgacagagtaagactctgtctcaaaaaaaaaaaaaaaaaaaaaaaaaagaatctcttagctctagtttgttgtcttactctaagaaaaaaaggatcccttggcatactaagtttatgagtaagtcttaaactgtggagcaatccaacattttaaatgaataattcaagttgcttagcatgtaaagtacataaaatcctgtatatactgtggttattattgcttgaattttcatgttttacaaatagtctctgaaataatattaatgaaaaaacttttcattttatttttatataaaactacagtatatgttataagtaagaaaacagtaataccatccaaaattcctagacaagtcacagtgtatgaggtttaccagggacatttgcaagtcatcttgaatgactcaattgtagaactgcctgggaacaactaatgttgaaaaacttaccatgagtcacatatccaaactgttatttaaaagatgtagaaatgttaatactcatttgatctagaaaatatttttataatttgattatatgccagttacagttcagtttttggataattatatcttaaaaagatatagatacattaagctagcacaagtgatgactgatgtaaagatgtaaaaagaataggattctaaaataattaatttacgaagaagctgaatttattttagtggaaaacttgagttgatacttagaaagtgtctgagtcatccaaaatgtgaattcattcaaatatctaatcatattttactgcgttatacctttaaactattttggctaaattcagaaaattgtccaaaaagtttaatgttatgtttgacgctaatatcaatttacaaatattggaaaacgtattcggggaataaatctaagcatatatgctatgtttacacagagaacagactaggtaaaaatagtttttcttggaggcagttgtgaataaccatcaggacaaattgaagttctgttctgtaatatctatccctaggaatgtttaaatatttataaaaatttacttaaagtatttaatattttaatacacgcaacacatttgtatgtaatcctaatttttttgatagaagatgctagttacaaagaaattatgttacttttatattttaagtacaattaagggcagatgccttatgaaatgttttaccttcttgaaggcccttcattcctgggatatttatgtagttctctctctctctctctctctctctatctatctatctatctatctatctatctatatatatatatatatatacacacactaaaaatttacatataaatttatatataaattttatttatatgtataaataaaattttagacagctgtaaccagccctctctctcctttgcccattcccccacaaataaaatttttaaagtaaatatcttaatagcctatctgattcagaatgttgagaaaaatgactattaactaatggctcagcattagagatttgttagcatgtttctcatcaattatggggctaagatttgtaaatttgtatattttggatttcagaagagcagggtttaaatgcttctgttgtcagaaagtaaataaatagatgccattttgtttggcttttaacctaaagtcctttagcatttacttgaattcagtcatttaataacacttcaagggctggtattgagtgtttttgaaggttataatgcagctagcatttaaatatttttcatcaggaaaaaattgagaaaataggaaatttattttagctttttatatcctaggccaaataactgcttcttacatatgcacactttcaagtcaataaagaggaaaagactctagcagccttacattattagtggaagaggagctgtagcatacaaattttgaataagttgctctcaaaggacaaagaatttatttactacataaagtaggaataagacatagtatatattttttctgtgctcaatctcgtgagtacgtgctcatttataaggtttgcctttcccatgaattaaaatatgataaatgtagcattgattgcacaaaggagaaatagaaaatgagaatattaattggatttccaatctctgttccacatcttttctttttaatttgagaattattgcaacatttatatgctggtaaaaatcttccctgtgaagatactaataatttctttaataatttgatttatgtaatgtgctcatgtgtagaattaatttcactatccaaattaaaagtggtatgttagaatgcctgtatgtttacatatgcacaatgtatgtgtgtgtgtgtatatatatatatatacacacacacacacgcatacacatacacacacatatatacatacacacttgaggaatgtggatataagtattattatcatttgggggataataacactgttacactgtaagtttcctttcaaataagaaagtagagtaacacatgtctaggcatgttctcagagacacatttaagtacgttgtatgcagaaaacatgccacataacctttatttacacttgaactacccctccatagtttcattatgtaatttaattttctgacactactaccttcaacttctaaaaaaaagtggtattatatacataacataaaattgacaattttaactattttaaagcacatagctgagtaatgttaagtataaaggacatcagaatatgctaccctaaaatatgcgaatttagcataaagatccttttgagctgaaggcaattaaggaaaagcaggcacaggaaacctctctactcttccccatctacctaaaagtagggcatacatttgacttataaaagcatcccccactctcataccaggaggagaagagcaacctttattagcagaaatagaaatgctgtcaggataagccagcataaacaaatctcactaaataacctttattatccattagtttccctcctgcattacagagtttcccaccttagaagccccaaacccttttcctttgtcttgccacttctccacaatttatcacccttttttaaaacgtcatataaacccactgagtgtcactacttgtttgggtcttcacttcttttctatgaaggtctccgttcatgtgaaaatcaaatgattataatcaaataaaatgtgtatgccttttttccggttaatctgttttttgttagtttaattcacaagccccagttatagaacctaagaatgtagaggaaaggtttttctcttccctgtaagtgaatttacattgttgtgcaatgaatctttagcattattttcattttgtaaaactgaaactctatagccgttaaacaggaactccacatttctccagcccctaccaaccaccattctatgttctgactttctaaagttggtattttcagcatttatcgggacctaattgtgtaccaatgaaaactaaaatatacggttttacattagagaatggaatgactatatacatatatatgtatttgaatggaatatatatatttgaatggaatatatatatatatttgaatggaattttatatatatatatatatatatctcctagtatgtggcagtgtgaatttagaagtgccattgtatcaaggcatgatgaaggacagttttacaggaaggtgtatttggaaccaagctttgtaagatgaatttgtgtagaatcaggctgacacagaaaggagacagcagaaaggagagtgtagacaagcaagccagttctggttagaggagggccaatgaaactctttgctaggaatgtgcatcataggtaaacaggtatggagcctggctactattttatttatacacttaataattcatatattcaagtttaccaaatacctatttgtttgtttgtttttgcaaattctaattgagaaagcagaaaatctaattttcactttctaaatctacctggtaatcatatttttacttatgtttttcctacttgagttatgtaggcctgaaagggtttttaaaatattatccactatcatggttgttaatgtgttcttatatttctttctttttttttttgctgggattttgcttttattttttatttttattattattatactttaagttttagggtacatgtacacaatgtgcaggttagttacatatgtatacatgtgccatgctggtgtgctgcacccattaattcgtcatttaacgttaggtatatctcctaatgctatccctccaccctccaccttcccccctccccacaacagtccccagagtgtgatgttcccctttctgtgtccatgtgttctcattgttcagttcccacctatgagtgagaatatgcagtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcacgtgtctttatagcagcatgatttatagtcctttgggtatataaccagtaatgggatggctgagtcaaatggtatttctagttctagatccctgaggaatcaccacactgacttccacaatggttgaactagtttacagtcccaccaacagtgtaaaaatgttcctatttctccacatcctctccagcacctgttgtttcctgactttttaatgattgccattctaactggtgtgagatggtatctcattgtggttttgatttgcatttctctgatagccagtgatggtgagcattttttcatgtgtcttttggctgcataaatgtcttcttttgagaagtgtctgttcatgtccttcgcccagtttttgatggggttgttttgtttttttcttgtaaatttgtttgagttcattgtagattgtggatattagccctttgtcagatgagtaggttgtgaaaattttctcccattttgtaggttgcctgttcactctgatggtagtttcttttgctgtgcagaagctcttgagtttaattagataccatttgtcagttttggcttttgttgccattgcttttggtgttttagacatgaagtccctgcccatgcctatgtgctgaatggtaatgcctaggttttcttctagggtttttatggttttaggtctaaagtttaagtctttaatccatcttgcattaatttttgtataaggtgtaaggaagggatccagtttcagctttctacatatggctagccagttttcccagcaccatttattaaatagggaatcctttccccattgcttatttttctcaggtttatcaaagatcagatagttgtagatatgcggcgttatttctgagggctctgttctattccattgatctatatctctgttttgataccagtaccatgctgttttcgttacagtagccttgtagtatagtttgaagtcaggtagcgtgatgcctccagctttgttcttttggcttaggattgacttggtggtgcgggctcttttttgcttccatatgaactttaagtagttttttccaattctgtgaagaaagtcattggtagcttgatggggatggcattgaatctataaattaccttgggcagtatggccattttcatggtattgattcttcctacccatgagcatggaatgttcttccatttctttgtatcctcttttatttccttgagcagtggtttatggttctccttgaagaggtccttcacgtcccttgtaagttggattcctaggtattttattctgtttgaagcaattgtgaatgggagttcactcatgatttggctctctgtttgtctgttattggtgtataagaatgctcatgatttttgtacattgattttgtatcctgagactttgctgaagttgcttatcagcttaaggagattttgggctgaaacaatagagttttctggatatacagtcatgtcatctgcaaacagggacaatttgacttcctcttttcctaattgaataccctttatttccttctcctgcctgatttccctggccagaacgtccaacactatgttgaataggagtggtgagagagggcatccctgtcttgtgcccgttttcaaagggaatgcttccagtttttgcccattcagtatgatattcgctgtgggtttgtcatagatagctcttattattttgagatacgtcccatcaatacctaatttattgagagttaatagcatgaagagttgttgaattttgtcaaaggccttttcggcatctattgagataatcatgtggtttttgtctttggttctgtttatatactggattacatttattgatttgtgtatattgaaccagccttgcatcccagggatgaagcccacttgatcatggtggataagctttttgatgtgctgctggattcggtttgccagtattttattgaggatttttgcttcaatgttcatcaaggatattggtctaaaattctcttttttggttgtgtctctgcccggctttggttatcaggatgatgctggcctcataaaatgagttagggaggattccctctttgtctgttgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcccggtttagtcttgggagagtgtttgtgtcgaggaatttatccatttcttctagattttctagtttatttgcatagaggtgtttgtagtattctcagatggtagtttgtttttctgtgggatcggtggtgatatccgctttatcattttttattgcgtctatttgattcttctctcttttcttctttattagtcttgctagcggtctatcaattttggtgatcctttcaaaaaaccagctcctggattcattaattttttgaagggttttttgtgtctctatttccttcagttccgctctgattttagttattacttgccttctgttagcttttgaatgtgtttgcccttgcttttctagttcttttaattgtgatgttagggggtcaattttggatctttcctgctttctcttatgggcatttagtgctataaatttccctctacacagtgcttcgaatgcgtcccagagattctggtatgttgtgtctttgttcttgttggtttcaaagaacatctttatttctgccttcatttctttatgtatccagtagtcattcaggagcaggttgttcagtttccatgtagttgagcagttttgagtgcgttttttaatcctcagttctaattagattgcactgtggtctgagagacagtttgttataatttctgttcttttacatttgctgaggagagctttacttccaagtatgtggtcaattttggaataggtgtggtgcagtgctgaaaaaaatgtatattctgttgatttggcgtggagagttctgtagatgtctattaggtccgcttggtgcagagctgagttcaattcctgggtatccttgttaactttctgtctcgttgatctgtctaatgttgacagtggggtgttaaagtctcccactattattgtgtgggagtctaagtctcttcgtaagtcactcaggacttgctttatgaaactgggtgctcctgtattgggtgcatatatatttaggatagttagctcttcttgttgaattgaaccctttaccattatgtaatgtccttctttgtctcttttgatctttgttggtttaaagtctgttttatcagggactaggattgcaatccctgcctttttttgttttccatttgcttggtagatcttcctccatccttttattttgagcctatgtgtgtgtctgcatgtgagatgggtttcctgaatacagcacactgatgggtcttgactctttatccaatttgccagtctgtgtcttttaattggagcatttagcccatttacatttaaggctaatattgttatgtgtgaatttgatcctgtcattttgatgttagctggttattttgctcgttagttgatgcagtttcttcctagcctcaatggtctttacaatttggcatgtttttgcagtggctggtaccggttgttcctttccatgttcagtgcctccttcaggagctcttttagggcaggcctggtggtgacaaaatctctcagcatttgcttgtctgtaaagtattttatttgtccttcacttctgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcagctttggtgaatctgacaattatgtgtcttggagtagctcttcttgaggagtatctttgtggcgttctctgtatttcctgaatccaaatgttggcctgccttgctagattggggaagttctcctggataatatcctgcagagtgttttccaacttggttccattcaccccgtcactttcaggtacaccaatcaaacgtaggtttggtcttttcacatagtcccatatttcttggaggctttgttcatttctttttattcttttttctctaaacttcccctctcgcttcatttcattcatttcatcttccatcactgatactctttcttccagttgatcgcatcggctcctgacacttctgcattcttcatgtagttctggagccttggctttcagctccatcagctcatttaagcacttctctgtattggttattctagttctacatttgtctaaatttttttcaaagttttcaacttctttgcctttggtttgaatttcctcctgtaggttggagtagtttgatcgtctgaagccttcttctctcaactcatcaaagtcattctccgtccagctttgttccattgctggtgaggagctgcgttcctttggaggaggagaggcgctctgctttttagagtttccagtttttctgctctgttttttccccatctttgtggttttatctacttctggtctttgatgatggtgacgtacagatgggtttttggtgtggatgtcctttctgtttgttagttttccttctaacagataggacccttagctgcaggtctgttggagtttgctagaggtccactccagaccctctttgcctgggtaacagcagcgatggctgcagaacagtggattttcatgaaccgcgaatgctgctgtctgatcattcctctggaagtgtctcagaggagtacctggccatgtgaggtgtcagtctgcccctactggggggtgcctcccagttaggctgctcgggggtcaggggtcagggacccacttgaggaggcagtctgcccattctcagatctctagctgcatgctgagagagccactgctctcttcaaagctgtcagacagggacatttaagtctgcagagtttactggtgtctttttgtttgtctgtgcccagcccccagaggtggagcctacagaggcaggcaggcctccttgagctgtggtgggctccacccatttcgagcttcctggctgctttgtttacctaagcaagcctgggcaatggcgggcgcccctctcccagcctggctgccactttgcagtttgatctcagactgctgtgctagcaatcagcgagactccatgggcatagaaccctccgagccaggtgcaggatataatctcctggtgtgccgttttttaagcccattggaaaagcgcagtattagggcgggagtgacccgattttccaggtgccatctgtcacccctttctttgactaggaaagggaactccctgaccccttgcgcttcccgagtgaggcaatgccttgccctgcttcggctcacgcaggatgcgctgcacccactgtcctgcgtccattgtctggcactccctagtgagatgaacccggtacctcagatggaaatgcagaaatcacccatcttctgtgttgctcacgctgggagctgtagaccagagctgttcctattcggccatcttggctgcttcagtgtgttcttatatttctaatattttgttttgttccctatatttttgttccatgtgacttaaggcagaaatactcaattatttaaacctcagcaaaaattagagttcacagcaattaaatctgatagttttttccaaaaaaataagaaaatttaataaagaaaaagtaatttttaaaatgcagaaggtttggataaccaaggaatggaaaatgatgatacagttcagacagaaggtatgtgaggcctgtgagaggagaaaacaactcaattagaaagttgttaactatccatccaagctcattggcctgcagaggatgatgaagaatcttaaaaacaattttatttagacatgtgataatagtcaacaaggagattttagaacaaaaacatgatgtgatggaaatgatatttaggaagcgttattcttgcagtattatataaaaggtattatagataagagaagcctgaatttaataagattccctattgactattatagtcacatagatctgattggataaggaacttgtccaggacaatggcctaagaaacataaagcaatatgtagtaattaattaaaatgaagagaaaggaaaaacaccaaacttaagatagcttcaggagggatggcatgcggttgaattttcaactttatttgtatgtgtaagtatttgtgtatgtgcatttataggaaagacagaaaggaactgtaagtaaaaattatcctaagtatattttcaactgattttccagaataggtgacttactagatataagggaagtcaaaatatgactttaatgtttcaaattgggtgactaggagatttgtggttttgctgattgtttatgtttgtgtgtgtgtgtgtgtgtgtgtgtgtgtgtgtataaacatacatatacaaagagaaacacataaatgccacttttaatatggatagtagaattaattttgcacataagaacattagataaatcaaaatattatggaaactattattgttatcttcagaggcaagattttttaccagcttatgaaagctatagtaattctcaacttgaaaataaaagatgtgtaccagagatcagaaattcaattaatattctcacttctatttcatctttatgaaatcaatgctgcctttatctgtatattattaaaataattgtgcaaaatataatttttaaaaacagccatttgaaagtcagtctttgtggttaaaatgtgtatttttttattcgtctcatggaagaaatctaatttaaaaagcaaagatttgttttagtaaacatttgcagattgattcaatttaagaaagcagatagttttgttattgctagaaaaatcctatgtggaggaatatttgacttctgtattaaattacttctcactattttttgccccagatgttttctgtgcacataccagtttcttaagggaagggtaaattgttctaatgccagcttacaatagtattttgctgagggaaaatgtgattttatagttaaatagcttaactcatgatagtaagacatagttttgttgacatgagagatgttagcatctgtctaaaaattctcattgtatattataattaatattctcatcagcttgcaaagtctccctgtagaagccagtatactttctgtatggtaattgctgtttaaattagaaaatttatatttggactttgaattttaatatttaatgttgctatgtaattttgttcattaagaatattgaaaacaaggcccaaaataagttgcattttgttacattccaagtccaacttgaaataaatggagcatattaatggttatacttttaggataaaactatatatggacaaatatattttctacatatatttatgtattgcataatacatatatattcgacgtatatttatgtattgcatttatagtgtcttattttattttttccctaacataaagcattctttctattattttttatgtcttttatttgtgagttatactgtagatacagatagagacattttcactaaaatgtcataggagactttctggttatatttgaccagatagttaattttctaagatagtgttctatcttcaaatagaaatggaaagatcaaatagaatgtgattgttttatcatcatactatataaaatggcgttgaatttcaccatataaattcttaagtaaaattcacattttatattcatccagtgtctcatttctaagctatattttataagaaatttaaaagcaagtgtagcacatagttcctatccttgataagcttacgtagcatagtgattaggaagatatattttcccccatgacacagtttaaacacatgaattaataaattatgtgataatagtaaatgtagctaaatatcaatatttattgaatttttagtatgtatcagctatatattaagtagttgaactgaattatgacctggaattttcaatcaaagcccagtgaagtatatcatatgctttaatgtatttgtttatagattaggaaacatacttagaaaggttaaggaacttcctcagggtcatgcagctgacatttgaagtaaggctgtctaattctgagtatttgctctcaaccactacagaacaccaaagaatataaaaggggaaaagacaagatagagagttacattactaggaacttcatggaaaagatgaggcatgggttggcccttgaataaagtctggaacttatatagatataagggagaacacaaaggttccaaatggaaagacaaaagtcctttattattccatctcctcatgcacagaatagaatgattaaatagtgtgttgaagagactgatctaatatattaatgagtttatttgggagacggttcatacagtcatgctgacttgtcttaagttaaatacttaaatcactactctgaggcaggcttcaatgctgtccatcagtcatacgatatttcccttgtctatcctgttttccacttcgtaaattattattttataaattcatcactcccctccctcacacctataatacttcctctcaaccctcattctcattatcttaccttctgtttcactgagaaaaatagatgcaaagaaaactccccctagtctcaccatggcatctacccatctacccatttacttgaatttgtagccctttactctgctttctccactgttactatgaatacatcgtccatgtttccagttacaaccagcccatcctctaggtgtcctttcctcttacctcttaactgcttaagcacaagtgcactgttccaacaattctacccactttttttaagagatggggtctcactatgtcgcccaggctggatttaaactcctgggctcaagcaatcctcctacctcagcctcctaaataactgggactacagaatcctgcttacttctttaatcagttttctctcttcggttattcttaccagaatgcaaagatgctgtttatcctcccttaaaaacaaatgtataaacaaaatacttctctagcgaatgcttatcgtggatttgttcatttttcttttcttattccaaaaagttcttgaaagagttggctgtcactctcttgagccatctccgtaccaccattttgttttgaattccctgcaattgacttttatccccacaatacagcaaaattgctattgccgaggtcactaatgattgctatggtgctatatttaacagtcaattttcagttctcatattgacttgccagcataatttgacatggttgattatgatctcctttttgaaataaatttttcacttggcttttaagtcactacactggaatataattttctcctacttttctggtgattccttcccttcattatttgctgataccttttcaccctaaccccaagcgtagatatgtcctaagggtaaggcctaagggtaatgagctggctgattttctgtggcagtcattcccgtggtaatttcatgtagtgtgtcaatgttcaatatcatttaatctgcagcccagacttctcccctgatatcgagaattgaacatctcatggtattctggatatcttcccttgactatccaacactcatctaaatcttaagcaccagatagtcccaaactcagcaccagatagtccccacaaagcctcgtattttcaggaagttaatcctcttagaaaacagaaactccattctttcatttgctcaggccaaaccaggaagtctcattgcaccatctctttctcttactatcaacatctgactcatcatctcattaaaaatattaactcttatcatcatcttccctgctactattaatattttagtctaagctgcttatatttttacctgaatcattgtagcaatctactaagtgtttttgtttgttttggttttgtttttatttgttgttgttgttatgtttaattttctttagcacccttccatctctgatcaacataatagtcacagtgtgcctattaaaatataaagtcctgttaaattgtaaatcagttttgtgcttatttctctcactgcaaggtacaggtgaaccataccaagaacaattctactttaggacctttttacttcctattctctctgcctggaggtttctcctgaatatccacatggttttgctcccttaccttcaatctctttaattatgcctgaggttgcaatttttttgaatttgaaaaatcagaccttggcaatgaccttgagcagtaggatataaataactcccacatgctgagcattccaataatggaacagtagtcataaatgggttaacccatttatcatctctctaaattcttctttggccacattatataaaattactccaacccgtgacactttctactcccttattctggtatatttttctgctttgtactactgactacctaatataatgaatgttgttttacttacttcttttctttattatgaataaggaaataaaacatatttcttttctcactaaacataagttcatttaatgcagtggtcttttttattatttattttatttatttatttattcatttatttatttatttctgagacagcctcactctgttgcccaggctggaatgcaatggcactatcttggctcacagcaacctcctcctcctaggtttaagaaattctcctgcctcagcatcccaagtagctgggattacaggcacatgccaccatgccaggctaatttttgtatttttagtagagatgaggtttcaccatgttggccaggctggtctcgaactcctgacctcaagtgatccacccacctcagcctcctaaagtgctgggattacaggcatgagacaccgtgcctggccaattgcagaggtctttctaggggactttcatctgtatggtgggcactcaataaatatttgttgggtgaatttataaattaataaatgatgatatatattctgattgcacacagaagatgtgacaggcagaaaaacttgactttgattttgtaatcaaaagtaaacttaataggtttttagagacatactaagatgatgaaagaggtatagatctgtattgggatgagttagtgtttttttaatctatttttttcccagcaggacagtttagcctggagcagaataagaaaaaaagagaaattgaaaatagtctaatgttggggattactacagtgtgcactataacaaatcagagtgtaattgaggtagtcggaatttaatgatagctaagagaagactaacacattattacaattaaagttggaagtcctttttatagcttccatttattgagcaactaccgagtgccctagatgctaagtcttctaccttaaatcttcctcttcaatccttaaattatgcttagaaagtaaattgcattattcccattttataattaagggaactgagggaagaagagatacttttatttgggctgaactattggaaatgctttctcctgtactttcctctaaatttgttgccagacttctcttcccagcctttatttgatttatctgaggtttttggccattttcagctattttaaaagtctcatttttagatactatggtgcagcctagtttttggctaatactggttggccttcatactctccaatgcggcatgcatttatattttcattttttgtgagaagcattttggagactactttactgtaaaattcccagcagaccaatgactcccacctgatttctttcagtctctctcagttcctgcttcagacagaacaccacgcaagaacttgcttctgaggctctcttaccttatcagacagccctatagaggagagacttgagtgcaataattcttaccatatccacttccctgtagaattcatgactccttaccacatccaaatttgcaaaggtacttcttcaaccactgacttttccctactcagcccttataatctttttcaagatgattcctgccttacatgtctccaaacattaaaaaaaaccaagtcatgttactatcccatcacattctgtcataacccaaggcattacttcagattataattttatggccattaaacatttttgcaagagtgagatgctgatctcttaaaagcagttacaacctctgaaaatacatgttttaagattcccatcacttggcttaagagataagaagcacacttcttcccttccctagaagtagaaaataccatcatgtacctaacgcctttaaattcccttacttcattgaactgttcttcaaatttcttatcttctcccacataaattagagatgtatgatagattcactgttacaatatcagtactgctatctttccaatggcttcttttagaatttgggggtaacttatcattggctagcctcacttttcgtacttgctaaaattccaggaaggtgaatttttcttatctctatgcttaccacatttatctgttaccgcacagtatacaagcctcaaagtcaggaattgaacaaatctctctgactccaaagttttactctttcttctgcttcctacttgagtttcttgagagggtaaaagacactgaaatatgcatgcgataaggaggaaatggtcaggatactaagattataaatgtgagcataaatctgtgaaatgctgcagtgttcttggttcaacaactgtattcccattgtctaataaatgcattctatattattaatgaatattctgctagaatgtatatttcttcatttaagagatctaaaagttcatgacaattgcatcaagatgattgaagcagtctggagtagaaaaaaaaaataaatgtgagtcccacactggtatcattttagggagttcagaattggtatgcattgtggtaggagtagggacaggagagaacaacaggaatgattacgtgggtggctgagacagatggtgtggacttcaaataaagaaacccagaaggtggtggataaataatgatgagagtagcatcggagagtaaggaaaaattggacagttctatctcaagaactcaaggaataaaggatgaaatcagacttttaaatgtttactacctttaattatttaaatgatgtgacaacaaataacacttggaaaatcatttttcaatgtttttgttataacctcttataaacaagaggattagtttataggaaaagacaaggctgagcaacataacaaaatcaagtgtattttttttttttgttttcagacggtctcgctctgttgcccaggctagagtacagtggagcgatctcagctcactgcaagctccacctcccgggttcacaccattctcctgcctcagccacccgagtagctgggactacaggtgcccgccaccacacccagctaatttttttgtatttttagtagagatggggtttcactgtgttagccaggatggtcttgatctcctgaccttgtgatccgcccgtctcggcctcccaaagtggtgggattacaggcttgagccaccgtgccaggcacaagtgtatttttttcttttgaaaaattatattgtgattttacattctaacataaatactctatatcagaaataaacaaccactagaatgagaaacagaatgtcattacactggaatgtggtaaaaaagaaattgttgttgataaaagaaccaccaacttgtgtatgtggggaaatatctgtttaactgttaaagttttgtgttatgtagaattcttaaataacataataattttttaaaagtcactgagtgcctttcatcaacagttttgataatctgagagcctattcacctgtgaatgattttaaccaaagtaaattgcttcaactctgtgcttaatagatggtgtcagaagattgtggcccagaaaacaggatgctgaaagacatgagatgtacatgagatacacatgtttcagtcatagcctgagtatggtagatgtagtctaggagaacttggctgggaacacaacaccatgtcttcatattcatttcgaatgagatgggggtagacagagatagggtcttcctaaagaagtatattagtttgtttttatatatgcattatttgtgtcttataaagaacagtgttagataaagagacagagttaaatactgtaagatttttattctcactgtgcttaaaaatagcaaccaaaaatatttgttggcagaattaatcatattattgtcagttttaccattataaaacagtactaactagagtgttagtttggtgccacttttaaacatatgaatgtattttacaccttcttttttgtgtagatgaggtaatggaagtccacagtagtgagccgagttttccaaagtcacttatgaaaaagaacaaaactctgtctcaacccacattctttttttttattttatttttctatttttttttttatattttttattatactttaagttttagggtacatgtgcacaatgtgcaggttagttacatacgtatacatgtgccatgttggtgtgttgcacccattaactctttatttaacattaggtatatctcctaatgctatccctcccccctccccccaccccacaacaggccctggtgtgtgatgttccccttcctgggtccatgtgttctcattgttcaattcccatctatgagtgagaacgtgcggtgtttggttttttgtccttgcgatagaaggaaatagagacacaaaaaacccttcaaaaaatcaatgaatccaggagctggttttttgcaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctatgcaaataaactagaaaatctcaacccacattctttagtacggtgttctgttacccatctcactgctgttgtctgtttgactgactgtggcagttgtgctgattggagcagttttctatttggcctacagtagcgaggatggctgtgtgtcctttcatattctttagcataatcagaatcatatctgtacagtaacaagcccgaagctatcttaggacagggatagtgaatatagatgaacaccctaagaaataagttaataacaatgggaagttagtagaaatggtggagtttaagtaggagcacatagaaatatctgtcgtaaactgggttttaaaaaaagtggacaagaattcaggataacatttctaaaaatagcttctctgtcataagctgttttcctcagttctcactctgtatttcataggtcttagtttttttgtttataaaataatagtattgactttgatatcatccaagatttcttctagctgtaggatttcatcttaaaatgaagatgtcttaagatataaactcttcctaattaagattactgaaccatttggcatgccaaatagtgcaaagctttatatcatactgaatcacagatgctgaagtatttataaaacattttagtaggcatcaatgtaggcatagtgtaggcattacatagaattattctaatgtcccaacatatgagacaggaaaaaatagttaagaatagagcatggaaaaaaaaggggtgaatctaggaattcacaatctttatcaggaaaaactggtaataggggtaaattaccatatagatgatcacccaaaaggtgatctttgggcaattaattgcttaaatataagtgaaatatccatagatcatctatagcattctatttctgtgtaacattaattatatttgaaatttggagttatagcttaaattcttcaaatatttataagatttcaacaactagatatattttttgacaagaggtaatagaagcatgagatacttgtccttcaaggaaagatacgacagatttattacaacacacacaaaatctaaacttggtatccagagaaacaacatatataggatgtgagattcaggagaacaaactctgttgactaaacagagaattgttatgttaagttaaaaggttttttcaattatctactcaaaaagtttatttagctttaatattgaaaagttctttgtaaggaacataagaaaacgtgacgtggcagcctcaaatactagaaatttaaatttagaacttgattatagaatgaatatttgaatttgagcacacacatgtgcacaatctatacaaatttagaattcagaaaatcaaaaaatcgaccaggtttataaaaactaaaaaacaagtttttggtttataataagtcttaagtttaaggaggacagcagttgggtcttgtttttctttccccctttaatacattctaatatctagcaaagtatctgaaaaacagtctttactgaataacgatatctttaatacgttaagaaacacactgtttgaaaaactgaaatcaaagtgaaactctaacacaaaatgaaaaatgtgtctactgtcccaagagtgttccaaaaacatttcaaaggagaaaagcacagggaaatagtaagatgctactttctcatttttaagtgagtgttaatgtgagagaaaaatcaacaaaaatatttctctaaagaatagaataatataatctaacaggggtcaattagaagactgatatttttccttggggaacttttacctccttcactgtcttttaagacaaaattcatcaataatttgaaggaaccatcctgtttgtctgttttcctttgaggaaagtcctttctgtttaaagtttcttttttttaatttttcttgttttcttcacacattaggtaattatcaccattttcagagattggtaattaactgagacatatgtacatgcttacgcttacagcctcattatattatcaaaatacaaataaagttagttttagaaaggatgaaccattgatttgggaatttaatcatcttaagatgtgcttgaattgtttattaacattttattatttgtgtttatattaaaaattagttttcattaatatttagaattcttgcaatttaacttaataggaatagatgcagcataacattctgattcctcatagtgaaagaatttaaaggatattctggatctttctgttagaagaagaggaaatctaaaagaaggattaccaaagggcactgattgtagttttgagctggagaaagtgaaattagaccaagatctggactccaagctgagaagaaaattacacgaagagaaagctattagctgaactcagtagaaaggatatcactgggtcaaactccacaggtggaaaagattttcgattgattaccagttcaagagagtattgaacagagtcactttttgcttgacatctttgggcacaaggtgtttattatttaaagctctgtgtaagaagtttgggtgtcatgatctgtgtctggtacactggtcagtttttcttaaggtctcacgtgtctaaacaaaataactttttatttgttccaaaaaacttgtctagaggaactcaattcagtcattaaataaaaattgttggctgggcactgtggttcatgcctgtaatcttagcactttgggaggctgaggcgggtggatcacctgagttcgggagtttgagaccagcctgtccaacatggtgaaaccccatctctactaaaaatgcaaaaattagctcagtgtggtggcatgtgcctgtaatcctagctgctcaggaggctgaaacagaagaatggtttgaacccaggaggcagaggttgcaatgagcggagatcacgccactgcacttcagcctgggcaatgaagtgagactccatctcaataaatcaaaaccacaatgagataccatctcacaccagttagaatggcagtcattaaaaagtcaggaaacaacaggtgctggagaggatgtggagaaataggaacacttttacactgttggtaggacagtaaactagttcaaccattgtggaagacagtgtggcaattcctcaaggatctagaactagaaataccatttgacctagccatcccattactgggtatatacccaaaggattataaatcatgctgctataaaaacacatgcacacatatgtttattgtggcactattcacaatagcaaagacttggaaccaacccagatgtccatcagtgatagactggattaagaaaatgtggcacatatacaccatggaatattatgcagccataaaaaaggatgagttcatgtcctttgtagggacatagatgaagctggaaaccatcattctgagcaaactatcgcaaggacagaaaaccaaacaccgcatgttctcactcataggtgggaattgaacaatgagaacacatggacacaggaaggggaacatcacacaccggggcctgttgtggggtggggggagtggggagggatagcattaggagatatacctaatgtaaatgatgagttaatgggtgcagcacaccaacatggcacatgtatacatatgtaacaaacctgcaagttgtgcacgtgtattgtagaatttaaagtatactaataaaaatgaaaataaaattaaaaagaaaaataaataaataaatattgttagggcctatcaggttccaggaattgtgccagatcctgtaattgcaaatatgagtaaggcatattccctgccattgcagaatttatcttgtagttgagcaaaagtgaaaagtacacagaaaacaccttgtatattagaaaacatagcatggtcaattgatctgtttctctaataggcacatatagcacttttaaaattgtattcttctagggttgatagaggaattctattactaactgaactttgttgattaagcaactttcagatattcgaatatttgaaaggctaaaaaaaaggcagcctcttctttgaacaagcttttaggagtgatcactctaacagcaaacatctcctttgcatgtaaaattaagcaaaaacttttcttttactcctttcctttccattctccttttttcctaccacttcagcccaaagccctaaggtggcactgaacacagagggagggcaatggtcagtgtgagtagagagacacaacttaatgtagggagagaaaggcatccatgtgtgaccacatatgtgggtataagtagagcaaccacatggcatcagagcccaagcaggttgaggatagagtcctgatagaaaggcagccttgcttggggggcgagaacctgtgcaggttggtaccaacaatcctatggatggtaccctggtatggcatgtcagaacctgagcaaggtaaagaaggcatccttgtaggaggacttttcaaaatgcagtgtaagagcctgaccagagtaaagagtattttcacatgggaagggtactttcacccagcgaagttggagtgccaaagccaagtcaggtggggagggcatcagtgcatggaaagaaagcagtttgcccttcggatctggagtccaagtggggtgggtatgttgtccatgcagtatctggcccaggcagggtgtggtatggagcctggccaacgtgaagtggtctggtgtatggcagggtagtgcagagcagcatgtcacagagagatttattttaaggaattggttcacatgatcatagaggccgacaactgcagaatctgcagagtgtatcggcagactggagacccagggaagacatgatgcttcactttaaattcaaaggcatcctaccggcagaattccctcttcttcagaagaggttagtctttatctattaaagccctcaacttattggatgagatgcacccacattatggaaagtaatctgctttactcaaagtctactaattgacctaatttcatctaaaaaataccactatagaaacatctaaaataatgtttgaccaaatgttttggtccattagtgttgctacaaaggaaaacttgagactaggtaatttgtaaggaaagagatttggccgggtgtagtggctcacacctgtaatcccagcactttgggaggctgaggcaggcagatcacaaggtcaggagttcaagaccagcctggccaacatagtgaaacctcatctctactattaaaaaaaaaaaaaaaaaaaagtagccaagcatggtggtgggtgcctgtaatcccagatactcaggaggctgaggcaggagaatcacttgaacccgggaggtggaggttgcagtgagtgagattgcaccactgaactccagcctgggtaacagtgtgagactctgtctcaaaaataaataaataaaaaagagaaagaaaagagatttattggctaatggtactgtagtttctagtccatacacgaagcatggtgccagcacatacatctggagagggcctcaggctgcctctactcatggtgcaagggggaggggagccagtttgtgcagagatcacatcatgacagaaaagacaagagagagagacagaaaggagggaggtgataggctccttttaacaacctgttctctcaggaactgacactgcaacactccctcactccccgctaccaccacaggggacattaatcatgagggatccatccccatgacccaaacatctcccattaggcctacctccaaccttggaaatcaaatctcaacatgagttttggaggggaggggtcaaacaaaccatatccacactatagcaacaaatatctgagtattttagcctactcaagttgatacataaaattagccatcacatttgggaaataggctctgaggtataagtagtctcattatggctgattttaagctatcaacttcacgtcactggatgtaaactacagaagaattatatgaacacaaccagctcttgtgagcaggtattagccagcagcagcataccactgagttgacttgagttatgaagtctgaatggaatcttcttccaatcctatggagggttttgagaatgggacacgacacccttcaaaactgccccatattggcactagtgagtgagtcagatcactatgccctgaatcaatcaatccttggatacaggctgccttcagaagggggcaaggctttgagaaaggcagctctcttcaatttaggcagttttcaaagctgggctgataactggagctgctcactggcagcactccgggtaagtttggtaataagttacttaatggtggatgaggatctaggcagcacatcgtagcttcatagcacccaccgtattcaatgatgagtctccgtgattgggtctcactaaatccataaaaagaaattggaggctgactctctctctctctttcccttagagagagagagtaagagagagagaacccagttacatccagagttctagggagcagaagcacagtgctgcaaggaagaaacttcagctgaatttcaggcagaccaaggctcaactgaatttcaggcagaccaaagctcaaattctaaaagtattattttcttattaccagcttagttgagtcatagaactagtctttcatcattgaaagtgtatacttttaattgttagggctactgttttaatcagggtttccagctgcagaaaagaaagattatttgcctttttcctgccttcttgttctatctgggaccttagccaattggatggtgcctgcccacattggatgagggcggatcttccttactcagtccactgagtcaaatgctaatttcttccagaaacaccctcacagatatgcccagaaataatgcttttccagctatttgagtttaccttaattcagtcaagttgacacataaaattaaccatcacacccaccaaaactgtattcaataagggaaaggtaggagatttgatgctggactgctatccacgttgtttacagtgaccatatatatgattgactcaggtctacacctgcttcctggaataactataataactgctcttttactccccaaagagcccagtttgagcaataaattacattgttatcctaatatgattgcttctacaagacaggcagaatagcaagcatagtgccagatgtcacaacctttcactgccatgtgaaacctgggaataataataataataccttttaagactgtcatgggaattaaataagataaaatatgcaaaaatatacatgctaagttattggaatagcacctaagtattattatattttccttgtgatggcattttatattgccccaaaatgagtaaatattaaaatgtccctacaatagaattccaacatgaaaatatccagtgccaataataaaaagaaagaaatgattgatttttaaacaaatgaataatactctggaacaacttgggtagtttgctggagaagctttcaatgcagaagtcttgggtcaaacccaaaatcttataagcagtagttgtttttgggtaatttgcttaaactttctcagccttgggtctctcaattattgggttgtaaattatcaaaagaatatctttaaagcccatagtatcttcctggccctcttagacactcagcaatgttaatttccctctcctggctgaaaaaagtaactgaggttaggaatatttttcagaccaaacaaatacatggagggcttggaaggagtcttccaaactcctcaaagcagagaggcttccatcctcaaactctccttatcaaataataaaattcttatttatggggaaggatgggagggaattaataccacctactactctagaaacttgttctcaattccgcttgccttctacctactccaccagaaacatttcctcatggcttgaacgacaatatgtagaaaagcatgctataaatttgtgtgttttcaatttataaaaatggtttcatatattacacctcagttgaaaatcaagacaatgcatgagttgtcaaatcaggtattagtcccattttgcagatgggaaatatgaaatcccaagaggttacttgacttgcctggataatacagttaataactggaagagacaggcaggatatgaacatacttttctgaactctaaagtgaatgatttgtctgctttggaacactctgaagtccctgactctgaaataggagctcctggatgtgttattaagacaggcacagtgaagtatgaatacataagtgctaaagtgtttctcagcttcacagcttgttttatcagctatttcaagactatttccacttgagagttttgtacttctagcctgctgtgagtcactaatgatataatccattttggaaatggtggtaaattatgggttgtggtaactctgttatgaacttattattattaattacttgccatcacttgccatctcaattgtgttttgttcagtaaacataatatccatgctcaatacaaaaattaaatctttctttctcatacacacacacacacacacacacacacacacacacaatgctaagccagtaataaattttacttgaccttaagtttgagcctcaaatatgaatctggattcctgaaaaattgagtttctaactatctttgccaaataaatatttttgagggtgaatttcaaatgaccatgtctaataaaaatattattttaaaacttatttttattttttacagatgcataatagatgtacatagtttgagggtacatgtgataatttaatacattcataaaatttgtaaagatcaatccatcaccttttatgtttgtcttttctttgtgctataaacattcaaatagttctctactagctattttgaaatctactatacattattttaaactattatttccctactaatgtatctaacattgggtgttattccttctatcatactgctttttggacccattaatcaacttttctttatcctccctccccactaccctttctggcctctggtaaccaccaatcttttctgtcttcatgacgtccatacttttagctcctactcatgagtgagaacacgtagtatttatttttttgttcttggcttatttcatttaacatgacgtcaagttccattcacgttgctgcaaatgataggatttcattcctttatatggctgaataatattctagagtgtgtgtgtgtgtgtgtatgcgcatacatacagagcacattttcttcacttatctgttgatgggcacttacattgattccatatgctattgtgaatagttcagcagtaaacatgggcatacagagatctatacaagaaaaaactatacaacattgatgaaagaaattgaagagtacaaaaaaattgatagatattctatgctcgtggattggaagaattaatattgttaaaataacaatactacccaaagcaatttatggattcactgcaatccctatcaaaataccaatggcattattcacagaaatagaaaaaaatcctaaaatttatatagaactacagaagaccccaaatagacaaagcaatcatgagcaaaaaagaacatgagtaaagctataggcatcacattacttgacttcaaaagttactgcgaaactgtagtaaccaaatcagcatggtattggcattaaaacagacatatggacaaattgaacagaatagaagacccagatataaatccacgtatttacaaccaacttattttcaacaaagatattgagaacatacactggggaatgaacagtctctttgataaattgtgctggggaaactggataactgtagaagaatgaaactagaccccaatttctcactatacacaaaaaaacaaatcatttaatttgattttttaattaaatttaattaattaaatttaaatttttaaattaaattaaattaaattaatagattgaattaaagacttaaatctaagacctgaaacaatggaagttgaaagtcttaaagaaaacatttgggaaatgatccaggatattgttctggaaagtattttctgtgtaagactttggaagctcgagtaaccaaagaaaaatagacaaatgagataacaaagctaaaaagcttctgcacagcaaatataacaatcaacaaattgaagggacaacccacacaatgggagaaactgttagcaaacaattcatctgacaaggaattaataaccagaatatataaggagctcaaacaactcaataacaaaaaattatctgacaaaaggtctgaatagacatttctctaaagaagacatacaaaaggccctcaagtatatgaaaaaatgttcaacatcactaatcatcagagaaatgtgaagcaaaactataatgagacattatctcactccagttaaaattacttttattaaaagacaagcaataatagaagctggaagctggcacagatgtggagaaaggggaatgcccacacactgttggtgagaatgtaaattagtacagccactgtagacgatagtatggaggttcgtcaaaaatctaaaaggaaaaccagcatatgatccagcaagttttctgctgggtatatatccaaaagaaaggaaatcagtgttctttgaacttaaattagatatagataatttaattgtgatgagtttgcaatttatgattttcttgatttgttgtttgcaaagataatttaaggtacattaaaattacgcagtctcaaccccttcactgattggctggatggtctaagtggatttagctagactacctcagagtgttttcaaatgcttaatcaaatactggtattcctgttaagggaaagtgaatagggcagatgcaattacagtttaagctggggtgagcagctctactctagggcactacatctatgaaaccacacaaaaggcagacactgatctgtatagtcaaagactctaagaaacaagtgaactctggggtgtacagggtaatattaaattcaggtagataaatctgaggattttttaagctaacataacagttccatgagcaagttggaaagcatttaatgaaatagatacacacgacctttgaaaagtgaacattaacttgtacttgtctaaaataatcctttctagtcaaagaaggtttttaagcaagatgagttttggagtgtttgagtttattaggtttacttaaagatataacctttatttcctttcttctatgtaaggatatacaggaaacttgacatttggttaattgactttttacatttctcattgggaaataagactgaagctttatgaaaattcaaatcaactacgtatatgggatttttgtttctgctatgtctcatttttcattgatgactacaatagaatattatcacgtttttctagctgcatgtctattataataataaacattttcagtcttgggaaatgaagaaaatcttcttgtcaacataactgtattgctttccatatacttgattagaaagcctttgcatattaaaaagagatttactgaagttcttatgaaaacttgagctgatatttcatttcaatgtggttataataactagtatatttttcttgagcaaataatgcataatattccctatcattttgttaatttgattagacgggttataaattcaggttttctaatctttgaaagaaccagtgagccaaacatctgcatattcttacccaatgaatacacacctctgttaggaacttaactcataattggaggaactctagcattctcttttcattttctggaacattttagtttatccagtaaacacatcagtacatgacatagttaatctgttcttttcagatgttctcctgatcaatactgtgatcaaatcaatttataaacatccacatagatcacataacaagacactttcaatgtaatgagattcattcattctgtggagaaagacatgagcctttctactgtctgaataaccacatttccatacagatactcaatatgaaaggtgttagtcaggtggcagaactgaaaactattctggagggaataattgaagctaaatgggattcttagtgctaatttggaacaagcaggatattttaccaagctgtttggggattcttaacctttaaatgccacaggctccttggaaaatcttgttaaaactatagaaaccctctgagaattaatttttaagtgtacaaaataccaaaaaatatatatattgaaatatggtcaccaaaatagtttaaaataaatgtgtagtagggtaatatatactggaaaattatctctatcttgaggtacttctaataactatcataatttcaaaatagtaacaagcatacatgataatcccagacacttgcaactataatgttcttatgaaaaatctatgatttatattatggataaagtaccagttattgcagtacgtctatggtttgctgcttatagtcataattaaagtaaatgttatttcttacttagaaattaaggaaacatattttcccccatccaagtttatgaattctaaacatggaccactgtcaaggtagtaaaaaaaaggttaagaaaccctgtgttaatgatttctctgagaggcagaagtgataacgaaaacattagactatgctacatagatcaaatatacacacagacacaaaagagagaacataacccattttgtactagaatttccggttctttgttataagaatctgtgcctcttagaagtcagcatgatgcagagtatgtttgtttaaggtctagtagaacatatatattatttatttatttatttatttatttatttatttatttatttatttatttatgggatggagtctcgctgtgtcacccaggctggagtgcagtggcgcgatcttggctcactgcaacctccgcctcctgggttctcctgagtagctgggactacaggcgcccgccaccacgcctggctaattttttgtatttttagtagagacggggtttcaccgtgctagccaggatggtctcgatctcctgacctcacgatctgcctgccttggcctcccaaagtgctgggattacaggcttgagccaccacacccggcctagaacatataatttaattaataaatattcattttaagaattcctgatatcaaaagaataacaagacagctatttggtttatggtacatatttattatggataatggtatgaatgatgttacataaaaccaggaagaggaaaaccatgattaagatgttcatttagtttgtagtgtttctattatggctattgtgctatccatattcccctaaaatgctgatttttgaaaaggtgtttaatatatctcatttaacatgtcaaagcaaagggaaaattcttaataaaaatacttagtgacttcattttatttaaatattttcttagcccaaatttatggttttggttatctagactattgttacttaaattgtgggccagggagcagcagcatctgcaactgcatgggaacttattagatatgcagattcatgagacccctctccactccaaacttactgagtcatcatttggaggagtatggctaaggaatcagtcttttaagaaccatacataatgttcaacaacaataactgccagttaactaccaatatttaaacttagaaagattttatattaaaagaattcagaattctaatctcaagaaaaaagaaacagacaaaacaaggatctgctgtggtacatccagacaatggcatatcattcagtgatagaaagaaatgagctctcaaacgagaaaaagacatggaggaacctaaaatgcatattgctaaattaaagaagacaggcttagaaaggttatatatagttgaaactctatggtttcaactatatgacattgtggaaaaggcaaattacagagacagtgaaaaagccatggttgccaggagctggggagggggaatgaataggtggaacacaggattttagggcattgaaaatactcttgtgatactacaatggtggatacatgtcattatccaatggtgaatccatacatttgccaaaacccagagaaagtacaccaccaagagtgaacctgattgtaaactatggactttataataatgcatcactattggctcaaccattgtaattaaagtagcgcattaatgcaagatgttagtaacagggatactgtgcagtaggaatagtgggctaggggaaagggaatatatgggaatgctctcaatttttctgtaaacctaaaagtaaaaataatgctatttaatatatatgtacatacatatatgtgtgtctacatacatacatatgaggcagagaaagaccagacctgaaaagagacctggcaacacaggactatatttttgtgtaattctgcagctgagtagtagctacccctttttgaagggccaaggacacaccaacttgcttcaatgctcaacttgccattttaagaatttgatttatatacttctggcttctgaacctttatgactcaagtaatgcaaaagcaagttttaggagcagaattggtattaattcattcagtaattgcaaattatttgctcttgagaactctgggagaggataccactgtcaccgtcttctgttactactgtgcttacctgtgattattgctgcagctgggccaggaaacatgccaacccttattcaccactataagttaggtgctaagataaggtagaaacttgctggaggtcacacaagtacactggctggaagagggtactcagaatcaccaggctatgccaaattgtttctggttactttttcatttggtagatttggcagatatttttcaaatggaaattagaatttagtgtgaagaaatgttatctaaaacatgggaactgctaagggaattgaacaatgagaacacatggacacgggaaggggaacatcacacaccggggactgttgtggggtggggggagggggagggatagcattaggagatatacctaatgttaaatgacgagttaatgggtgcagtacaccaacatgcacatgtgtatatatatgtaacaaacctgcacgttgtgcacatgtaccctaaaacttaaagtataattaaaaataataataataatgtcttcctctcgctcaatctgcacacggagttggtcacaaagtccttaattgtatcaattaacatattcttcaagtcttctctcactcttccagttccattgtcctcatcatttgctgcctgagggtttgcaatagcttcttaatttatctccctgttgccggcatcatggtcaatgtcctttcccattcagccagctccagtttctttcatgagtctgccagaattgtcttctaaatgcaaatagtaatcatgtggctcccttcctaacatctttcactgatattctagtctaactgctttagcaacatttaaaactccttcagacagcctttctaagtttatctgcagcctcagtcccaaaggtgcattaggatccaatcacacagaaccaatctgagatttttagagctctcagttttttcttactgataaaactcttttaccatggcgttccctttggtaagatttcctttattgccacatctgcccaataaactctcacttatccttcgtgtcccaacaaaattatccctgtctctgaaactccttctactctcttaactctaccccaggtatgttaagtagtaaccattaccagaacattctgtttataccaatattatatagtttattatggttaattttacctgtcagtttccctcatctagagaatacatcagagactattttttgtctattttcctagcatatagtaaatactcaataagtattccgtgaacaaatagatatgagtaaatgagtgaatgaatctgcatgtgaaatatataatgctgttttgctgatttcattacaaataaattgtgaaaagggaaatttgctggtaaattacatgtatgatttaacttcctgttgattctctcatactcattttaaaattaaaagtatatacaaaatgttcttaacgtcaggaagtgtgaggcaaaactgtcaaatgtggaatatcaactctgaaagcagcctgatttttgcagggttgtatctttgagtattaaagaactttactaacattcatttgaaatataatgtcttgggttttcatttgtattatgaaacaggccacaaagacgtactaaatgctcatctttaagggctttctttttctcatctgacctttataactgaaagaagcttcaagtacaatttcataagcagcaaagcagcttctccagaaatgacatttgtcagtatttctggtttggggaccctcttccatgataaaaaaaaaaaaaaaaaaaatcttaaaaggagtgttttcagctaactcagacatgattctatttgttacttgagtgcatatccaatcagatactcagggaggcagatgttttggacacacgtttctctatagctgacttagagtgcattttattatgtgcttggtttgaaaacaaatttcacagcaaactttacagaagtatgctgcttagtttgtaatgcagttcacacactcagcatgaataccaatttatgaaggtgtcatcaagttgtttaaaccaacccaaacacacataatacagatggcattgtaggcatcagtgcctgaaaaataatttgtgacatctgtagccttctctaatcatttcagttttttgtgctttttattcagtgactcttttatgccatttcaaaatataaatagactcataacaatatagaaattgttttttgagcattaaaatgaaaattttattgtatataatttttgttattttattatatttactttaacatagctagtatattaaacattttggtaggtctttttttctccttgccttttatggatctttttgtcaggcagttaaacaaaccacttatttaaaaaaaaatacaaatattgctgtttaaatttacatttacaatttcttgctgaaagatgtacgtttctacagttataagtacctgttaaaaaaatagatttgtttttttctgattataaatgtaattaatgcattttggaaacttttttaaaaatccacaaccatgtataagaattctaaaaatcaccatgcataataagcgtagttaaaatgttgctattcataattctcaccttctttttctaaattaaagtccctataggggtgtatctatctgtatatctaaattaacctgtgtgataaatattttatggtagttgttttatttttattttttcctaatatggtctatatacttaatttcattgctcttttttaatgtcattaactggagatctttataagcatgttagtgataaaacaagtgttaaatgaaaatatagttgacccttgaacaacatgagtttgaactgcactggtccacacatgtgcaaggatatttaaaaaaataaaaaccatcaacccttaccattggtgggttccacatccacagccaccggtgagtggtattgtcaggatgcaaaacctgccataggaaagagccaacttttcatatctgtggttttcacagggccaactgatagacttgaatatgtgcagattttggtatccactgcattcctagaaccaatttcccattgataccaaggaatgactatattgctttgaatttaatcaatactttattgttgtatatttagtcacttttatgattttgtaaaccatattgacagtaaagtgttgattatcagtaacacttcggggaacagattttagcactaggatgagaatttagaaggaaattaacaaaataaaaatgcatcacttaaaagaaaaatattttatccttgaagagaaaacactcctcagccttgctaccaatgaggcatttatttaatacttatgtttatagcatttctcatatttacattaacattttttctctctggcaggtaattggtaaaataacaattttaggttttattacttgatttaaagtgagtatgtattttccccaaaggaataatttaaagttgaaatgaaacaatgctattttgctttttgaaaaacaagtttgataaatttttacgatatgatatatatttatagtctttaaagttttaactataaaatacattctttttctgttcacagtaaatatttactggatctcataggtaaaaatagaagtaattaatattcttattaatcctggatgactgcaggttacctttacatatctcttacaggttgctcaaagtattttttcatactttaaaaataaattacaaataaatatttaacataaataatatttcaccattttcgtcagttccttagtatctaagctaatattacaaatgtcaaagtctactaattagtgtattccttaagaacattattagattttctctctctttttttttatgtttatatgttattggttatcatttgtctctcttcccttgtaagaacttttaatatgagagtctaataagattaacagtgataacataattgaaatactcagagatatttagggaattcttaccgaatatcaaacactatgctaactattatatatgcgttgactatttaatttagaacccactcaacttgtactatttctagctccctttgcttatacagaaacaaacgcttatagaggttaaacaaatggcccaacccagcagtgctagtaacttgagaaatagagtttcaagcccagggtgtctgactcccaaagatatgttaatcatttgactactaaacttgtaacaagacaatgtttcatttcttcaatgcatttccagttgcgcatactgaaaagcataaattgctgttttttgtgtgcgcatttggtaaaagtacttctacatatttgaaagttgtcaatgtattctaaatatcatgatcagatatatctgagcttcaaatggctgctttttgtgtacaataatattggttctattttgtggtcattaaggatctttctttccccctatccatgtggaataataagccagtagttctcaaacattcatcttaaaaattattgaggaacccaaacactgtttatgtaggttataactaattttatctgttttataagaaattaaagcagaaaaaatatatatttattatatggtatataatatataaaaatatgtattatatttatataatataggataatatatttattatatttgtataacatataaaatatatttattgacattggtgttgacccctttttaaaataagagtaggcctggcacagtgactcatgactaatcacagcactttggaaggcccaaagctagaggatcacctgagcctaagatttcaataccagactgcgccatttgtttctcagggacaaatcccacttgatcattgtgtatggtcttcttaatgtgctgttgaatccagtttgctggcatttttttcagaatatttgctttcatatttattagcaatattggtctgtaattttcttttcctgtagtatcattgttttggtttggtatcagaataatgctggtcttgtggaatgagtttagaattgttcctcctatttaatttttttggaagagattgagaagcattggcattgaatcttctttaaatatttgttagaattcatcagttaagccattagctcctagacttttatttgttgggaataaataccaaatcaatgtttttagttgtaattagtatgttgagattttctatttcttcctagttcagtctttgtgaattgtatgtttatagaaatttatctctttctgctaggttatccaatttgtttgagtataactgttcatagtagtttcttatgatcctttatacttgtggactctctttcatttataattgtatttatttgagtcctctctctttctctgttgtttagtctatctaaaaggttgcagactgagtatggtggctcacgcctgtaatcccagcactttgggaggctgaggcggttgattgcttgagcctggaagttcaagacaagcctgggcaacatagcaaaaccccacctctacaaaaaaataaaaacattagctgggtatggtagtgcatgcctctagtcccagatacttgggggactgaggcaggagaatcacttgagcccaggaagtaaaggctgcagtgagccatgatcatgccactgcactccagcctcggcaacagagtgagaccctgtctcaaacaaacaaacaaattgaaaaaaacttgtcaattttgattctcttttcaaaaaaaaaaattcttagtttcatttttcttttgattgtttttctaatctatttcatttatttctgctattatcattactatctttactatgttttttcttctgctaatttggggattagtattctttttctagttctttgaaatggaaagttaagtttatttgaaatttttctttattcttaatatagacattaattgttatagactccacagggtcttgctgtgttgccaaggctggcctcaaagtcccaggctcaagagattctcacttgttataaccttatcatgaattaacccatatattatttgaatttataaatttataatatatttgaacttataaatttataataatacatgggtaaaatatattatacgaatttacccatagattattatagaataaccttctttatctcaattgtgacaggttttgacctataatctattttttatatacatatacctgcctcttctcactttttgtaactcatagaatatgctgttttaccctttgctttcaacctttgtgtgtacttaagaataaaatgagtctcctggatactgtttttaatccattcagtgactctctgtgttttgattgaataatttaacttctttatacttgaagtaattattgattgagaaggatttattattgtcatgttaattgcttttctgttttttaattcctttgttatttttttcctatcttgctgtcttcctttgtgatttttttcttttcatagtgatatactttgtttcctattctgtatcatttacagtttcctctttgtgattatcatgtgtcttagtctgtttagtgttgctaagaatacctgaggctgggtaatttgtaaagaaaagggatttatttggctcatgattatgcaggctatataagatgtatggcaagagagaaaacaagagtagggagtagaagtgccaggccctttttaacaaccagctcacaccagaacttatagagcaataactcacttattactgcaaggacagtgccaaacctttacattttttcatataatatatcatttaaaaagttattgcagctctagttatttgtaatactttaatcttaacttttatattagaattaaaagtgatttatataccaccattagagtattagaattttcttaatttgatggtatacttacctttgccagtgagttttatgcctgcatatgttttgatgttggtaattagtatcttttcattttaactagaagaactttctttagcatttctagtaaggcaggtccagtgatgataacctccttagattttgtttgttgaagaaaataattatctttttatttgacagctttagtggttatcaatttcctagtgggcagttattttctttaagcactttgaatatgtcatttcactttgacctgacatgcagagtgttggctgaaaaatttacagataatttcatgaagtttcctttgtttctgataaattgcttttctattactgctttcaaaattctctctttgtctctgacttttgacaatttgattatcatatgtttcagtgaagatgtctttattctcaactaattggaattctttgggctttatcaacctagatgttcatttccctatttgtatttgaaacgttttttgtcatgaattatttaaataagctttctacacctttctctttctctatcccttccgagattctcatagtatacatattaattcacttgatagtgtaccataagccctataggttttcttcacttttttattgtttttactttttgtttctttgactggataattttaaattatctgtctttgtgttctctgattcttatatttgattaaatctgctgttaaagttctccattgactttttcagttcagacattatattttttagtttcagaatttctatttttttataatttttatctccttgttgaacttctcatattgctcacttattgttttcctgattttatttagtaatctataagttatgtttctaaatgattatttctaaatgattacctacaatgaagaatctgactccatatcaaggtactttctatactctgccgtattaaaatgtattgcctagcttgtagttcaaatggatattttcactcatgctaaactttgtaatattatttactgttcatttggaaaatattttttacttaattattacagtcttccaaatatagcatatttcatattacactagttggtagttttatgtcataaaattacattggctaatagcatcaccaatctcatcagagaattttttttacacattgtaatgctttcaagctcaaggtgaatgatacaagtattcttaaattgtaatttttgtttaaaatcttgaatttttattatttttaaaaatctactactgtcagctgtttacatgaatagcagcattattttgttaattttgaagaaaatattaggcaaattcccaattgttaaatgacagtttgtctgtcatccatcctttccagtaacaatgtcattagatgaaaaaaacagatatgttagtttgcaattcaaacaatctcatgattgcttattttaggcaaccattatatttacgtatgtagcagaagttctttgggcatgctctccgtttcatctcacagaattttcaaaaggtacatgttgttgctgcttacgttatttttactgggaggtgaagaatttaatgatcactagtatagtttgctgccaactggatttctctaagaggccagcaacttacctaccattgattttacatcatcagtacaaatgtcaactctgtgacaaaggcaaatatcttagttttgctttgaaactagttgagaaactctacaataatccatcaaaacttctttgcttggttctacttgaaaccatatgcctatgttattgagctaaagtaaaattgttttctcacagtcctagtagacttacaggttaagcccatgactttgaccctgagtgcacaaaaggactaatttagaagaatgtgttgcattaattgtgattatactctttgccttcaaacttaaaccaaatcatataggaagccagatgtcaaagaagcattctatcattgcttcaagtttatatatggtaacaaactatgtattgagaaagtatctttctgatcatatgccattaagtctgagtagaaataagaagcaagattaaataacagaaccaaaaaaaaacccccagtttattatgaaaataaaatagtatcaaagtagtcttacaacttttctagttttatccctcttacagactcagtctgaattggtgagtttattgccctatagaaaacttcatggttatatgaggaaaagtgaattctggattaccagttcatattgcttaatcaagatctgataaagctcttcaacctggtgctttttgtcaaacatatctgattttactgtattttaaattaaatttaaaatgttttagacacataaatgcacttttaaaattgtgtctagtataattttagtaacattttttatttaaatattctccagaaacttcttggaacagttaagtgaatgagtaagaaagagataggagaaaacacacacacacacacacacacacacacacacacacacacacacaacttctaaacatgtttggaaacctcaggtggaatccactctgaggggtatcagccataacaaacatgttaatatatcactgttcacctcatgatggtttcgaaaatttcctttttttgaatatgcagatttgggctagtcagctcaatggtacatttattagcatgtaagtttaagtcattgttttattacttatccttattacactacatgactcattaaagttataggcattctaggaagttagagagacatgtgagctcaaaactggatgtagacctaaacaactacctgagagcacagaaaataaaaactagagatggggaaaagaaaggcaactaatttactgcatacatacaaaatattaaaatggcattttttaatgttataattaaaatagtttttttggtgtttctgtgacattttattagggtttttctgaccataagtgacagaaatgcaaaccctactagttcatcaaaaatagatatgtaatgaagattgttcttttctcttagtattgatgagaagaattcccttggtgatttcacagaaaaagtaagccaagaaaagagtagtgatgtagctaggcatcaggcattctctctctctctctctctctctctctctctctcctgtttttctgttcatattagcttcattcttttctcacagcagtgcaactttccccaaatggtggaaatatgacctccaagatttccatctctagtaacatgactcttttgaacagatgtacaaatgtcagggaaggaactcatttgcctttggtcagatgaatgctctgtagccacgcagaataatgataagaggtcggagtaagggcagtccctgcttgaactatatggactgagtacaaggtgtcaacagtccccaaataaagaggggttattgtagctgaggaagggatggatactaggcagacaaaatataagtttgcactacagagattcattgttacaagattttaaaaatcaggtcaattaagttattataaattatagttataagatgtatccatgctgaataaaaattaaatccattactaggccaactgccagctgaggaaaacaaaacacaaaaagatgctatgattgtgagcctagcaaagctttgcatgtaaattaattagtatttattaatgttaaagcaaaaaagataagaatattaatctcctaacagcaaagaatatttgatgaacagcagactattttcaaattagattgctgaatatttcatttgtccttgtatataacaaatggagtaggatgtgaccttttttttatttaactttaatgttattttggaaataaaaattatcatggggaaatgtataggctatttcattcttaaagtacaaagcatatctcatactcaaaatatagtatttcatttttctgcacatttctctagataatatttttaagactgtagtttgacagcttactaataggttggtgcaaaagtgattgccattacttttaatggcaaaaactgcaatcacttttgcaacaacttaataactagtcttgaatcaattatttaaatttactatgcctcagtttcctaacataaaaaaacgggcttaataatccaatccaaaaaaattaaaatttttgaattaggtgatttaaggaaaacgtttggaactaagataattaaaaagctgttcttattcatatagttgtactctgaccattcagactagtgtatagagatggaatggagatgcttttaatgttcttattcatatagttgtactctgaccattcagactagtgtatagagatggaatggagatgcttttaattataaataggacatataaaatttaaaagttggataatgttatggactgaatgtttatgtccccaaaattcatatgtggaagccctaacttccaatgtcactgtatttggagatggaacctttgaaaagtaattaggttattagggcaggaccttggtctgatggggctagtggccttatgagaagaggcaccacagtgcttgttcactttctctcttctcacgtgcacaccaaaaaaaaaaaaaaaaaaaaaaggcgtgtgagcatgcagcaacaaggaagagagtcctcacgtccgcacctgagcagccatgctggcaccctgatcttggatttccagtttccagaactgtgagaaaataaatttatgttttctatggtattttattatggcagttgaagcagactaagacagatgcaaattagaggtttacatagaaaaaaaaaaagaatgatttgaaatggtaaacataacagtgttgtcagcttccatcccaataaatatgtcactaaccacattttattccaccatccactcctactatggtggagtaggataagaatggattagtaataagtaaagctgtttgatctacattagtaaaaatagcctcacctcataggaaaaaaatggaaaaagattcacatgtttatacctataacagtgctacttaaattgttctattgttagctttaatatgtaaaatacaggtggttgttaaaaccatataaaaacctgaatttaaaatgttttttaaagctaaaatgtcaggtcataaaatacaccgtatttggtgtccttcttgtgtgtgtttttcgttatcttgttctcaatgaaattccctcaaatgctccttagaggcaggtttgcttgcagcagggtccatgatgtgagaggactgtaactcaattttctgatttaatagtgcagtgttattcaagcatgaaattacctattcatggagagcaatcccctttgcctggcaagtcaaggctcaaaaacttgatgtctactgtgattacagctgttgacccaaccaattgttgctagaatcagagttaagtttttctgtatgccccactgaggaaaatatgtctctgtgaacagctaaaaggtgaaaataggtatgtagctctccttagaatcacagcactatgtgattaacatgctgggttaaaaagaaccaaatataattatagcacaaatggaaagtatattgtttgaacttttaggttcagggatacttgaaaagtgtatttatttaattgacattcggtttaaacaagtttcttttaacaaaaattctaccaggtttaagaattacagaggaggcaaagtccaactcagctttgtctgtgaccatctgctctataggaaacaatgaaaaacaatttgattttcctcattaacctaatcaaacaccataagtgcagttgtttagcattgcaacctctgaagtatgaaaattcaaatagtgcaaacttgtccaggagtaattttgagccagaaattttaactacatatgtaattgtattttttcctagtaatcacttcaaaaaaggaaacaggtgaacctaattttaataatttatttttaatttatccaatatatcaaaaacatgattgctttcaacacttaacaaaaacatgtctgatgagatactttatattcttttattcatactaaatctttgaaatctggtgtgtatcttatacttaatggacatctcaatttgaaatagtcatatttcaaatgctcaatagccacatgcttctatcatattggactgtgcaaatctaccatccttaacatcgtaaaatattctctctgaactcaagggttttcagaacctttaagtggcaaacactggagatgtgaaatgattgagaagaacaaacaaggctgcctgctctaatgaggtgttttcagtatgataaggctatctaaaaaataagttttctttttttatgcaatgggaaaagtcacaaatattctctcacacacacatttgcacgcgcacgcacgcacacacacaccacttaaatttttggctcactgacttctcttttcctgagcagagtaatggattaagaagtttagatgtatttagactttagactagacaactacaatttcagatgaaagaaaagagcttggaaagctgcacttggaagcaagaaaattgtcattttcggatgagatttaacagagagtgataggagagactgaaaacatcaactgtaggaagagaaattcagaggggtaacattttattgtgcggtatgaatgtaatcaacctgagtaatccactccatagtttttggtaaagtttaaaccacttttcaacttggagagatgcttaactgatgatggttttctgaaaataacgtgatacctatgaaacgggaaaagttcccttatccccctcacagggcgtgcagtggggtgtggctcgcttcttcggtgccccaccactcaaaaccccttgggagagcaggcagatgggcaagttgtggggcttcgaccccacggcagtgtctaggggtgaatgttacagctcctgaggccccagtgggcgtgtgttaccatgtgcccttttagtttagccaaccgctgttggctgtgtttatcagctcagttagaccccccgccttacagcaagcacagagggctttctgtatcccagggtttcttgccttggtgtaccagaagaatcggatcacatgtgggcttggagaatgagtgcaaggttttattgactggaggtagctctcagcagatgggggaagccagaaaggagatggagtgggaaaggtggttttcccctggagtcgggctgctcagcagccaggctctcctccaaccgccccggggcaaactgcgcatcatttcaccagtcatggcttgacggtgcctttcagtgtgctctcaggccggtgcgtttctctccacgtccagccacttatcttcttctgtcagtgtgttcctctccatgtccagccgcttgtgtgcctgcccgctagggtctcggggtttttataggcacaggatgggggtgtgacaggccagggtgagaaatccaacatctgggtgcgaagccaggagtgcgtcctcacctaggtctgcgggtccaggcccgggggtggaaccctacccagggacccgcccttctcctcccagctcttccctgccccactcctgtatcacctacatggaccatgaagtcagccaggtttatttgggttatatttacattcacatggattgaatgacatatatatatatatatttaacagcattatgaaataaagtaacttgtccgtttgtgtgtgcaaacaaacatggtgtaaaacttcaggtttatctttataaattttttttatctttgttagccagcaattaggtccatttttatagatgtttctggtaatttgtttgttttagtcacatacatgaaatttttagaaatattatttaagttatttaaaggctgatcttgaaggacaaaggttttcagagtaaaaatctaaaagttttaaggttgttatcttgtgatttacttaaggcttatgtgtagcttgaaaaagatgttaaaatctctttgctgtcaagagctagtttcaatattttagaagcacatgacttaaaaatctgcactaataattctcattcacaacattgaaagttgggatttgttgagttctttaaattggctataagttccatttcttgagtaaaaagctattgaaaaaaataattagaatagttagagtaaatgtcacataaattaaaacattttgactaaactattagtgtgtgtttgtgtgtcagatcaacatagtcatgtgtttcttagcaaggaactattcacatatgttttgcttctgctcaggataagagtacaaatccctctggctctttctgaacaattacaacaaataattttatttgaaaatatttcataaataatttataattgttatacacacaaatattatatgtgtttattcttatgattcacttcaactttatctggcaatctcaaatgataactgatatctctagctgcttagttttttattcttgttaaatagaactcatggactcaggtttgcagacatccaagttgtgttgttcagttgcatctccagaattaggtcatctctccttggggggcagtagatggcctccctcagaactaaccagtctgcagttttgtttcctgaagaaccgtgaccatgacgaaacatcacttgaatgttgaaagtttttatttctctgtaacttttctccagcagcctgattacctccagattcctggcctgatcagtgacagccttgtcctgacagaggctgatgaaacacaccaccatgtcccaagaaactcttgattcagtgctgcaccctagtaccatagcaataataactcatgtaatttacctcctcttattgcttgagagtgaatgtcaaaagtttactttgctttctaatgtttataggtaatacgtgtgagcaagcttcttgggttttaataccagctccacctctgactatctatactgttttgggaaaattacctagcctccctaacctcaatttccaagtctgtaaaatgggaataataatagcagcctattttggaggattactgtgaatattagatgagttgagggcaagatgtgttaattcctgtaaaccaagttgaataggacctggcaaatggtaagcaaccaatagataccagttattattaccatcgtaagataagtgtatttttgcagcagtggctctagactgcacagcagaatcacccaatgaaaattttaaaaatcaagctacttgtgtcccagcctaaacttactgaattagaacctcaagaggtaagtctcatcatgtgttttttttcttttaaagttccaaagatgattctgatattgcagccaagtttaagtcttactgctgcaagaagatattataattctaattggtgtccagtttttattaattacaagttaatcatatactaacactgaccattctgtgctttattgactctagaccattattcagtgtcattattaatgtagatatctcaaatgagaggttgagaccaatttttttcctatgccatttacatgccatttttaaaaagtagagttgggaagaagagcccaccgggttgaagtttaactatgaaaatacagtgtagacagaaagggaaacctagattttagttcagccttagagtgaacagtcatttcctggggaattgttggtgaaaggttgaatttacatgaaccagatggtaaatctgaattttgttgtatctttgtttcccccagtatttccactgcccctttagagcacagttgcactacagtcagggtaaactttttcaggtttgccccaatattgttattagctaagatttattaaaggccctctgttttaggggcttcatatgattttatctcaataatgccacgaactaggaactaattaatatcatcattttacctataaggaggctgaagtcagagagattaagcaacttgcctaaagctgcaaagtttataagtagtgtagccaggatatcagcctggactctagagctgtattttttttttttttttactttaagttctgagattcatgtacagaacgtacaggtttgttacatagatatacatatgccatggtggtttgctgcacccatcaacccatcatctaggttttaagccccacgtgcattaggtatttgtcctaatgctttccctcccccttgccttccatcccctgacaggtcctgatgtgtgatgttcctctccctctgtccatgtgttctcaagagagcagtattcttaaccactgctctgtactgctgcctcccacaactgcagctcttcagcccatcccacttgagaataaatacatcatcttaaagatgactattttgggtaaacacaaatattcttcctctgggcatttctttctctctccggacttttgtcttctgctgcaggttttggccactactctaccttcattaaatttgcttttcttagcatttcaagttacagtgctattaaaaacagtttttcattttcttttaaaaatgtaccgtgggagaaatgcagccatctttccttcggggctctttcttttagacatgattaaacaatccacatcaataaatgactcaaccgggtgaaacagagaattcctaagaaaccataaatctcacaagtttcaaaggctgctacccatttcacattgttcagatgaaatatatcaccctaaattcaactttaatcatattattctgattgtctttgctccttatacttcagattttcaacactttggtctttttaatttttggtccatcctttgtttagtgcaaggccttccacacatataggagctcagagcttctttgtggtaattaaaaatgagcctcttcaaattttgaaaaaaaaaatattagctatggggcttaaatgaactactctgtctcaggtttcaaacaattggatagtgatattttccaaacaccctgcacagccaagcacttgcagtgaagtgattttgccactggggagcatctattctggtgccccaacccctgctcatggtaccagaaccctaactccattctgcagaactgtactgctcctattcatagatctatgattaggataatattgacccacccaagctagaaacagaaactgtgaagtccagtcttttgttcaacttaattgcatcaggcctgggcctgtgagtcagttcaaaccaatgagacattgcaaatatttgctggtgtcttttgggtaaaaagcttttctttccactgagacctatgaacacaatgttacctctttacttctggacattgaaatacaagattgtaaagcctagaactgttgcagctatttctgataaaaagagaaaagtcagtcttagaaatgatctgatactcaaaaaaaaaaaacaactctcatgaattacgtgtgagaattcagatcaaaccatagtcagagaactctgggctttttaattcctttttatgcttaaggctgcatcatctgtgatttttggctacatacaacataaagagttcaaattatatttcaagagagaaacagaagagttcatgcttgaattgtaagtgttcatagaagttcttttatttgttttctttaattttttattaatctactggtgttggtcataccaaagacacagagaagtgaaataattagctattcatagattcagaggcagcataaagatagaaataaaaagcaagctgtaacaaaatttaattcctgtttaaaggctttgattcaatcaacatgatcattaatatgtatttgaaagcgtaggtgattctaaaaggaagctactaccggtcactgttaagtgagtttgttttcagttgtataaactttgtgataattataaattcaaccatgtttcaatagtcacaatataattatagatttggactttcacaatcaaaagctctttggttgctctttgaattcatatttccaagaattgggttctactaaaattatcatttcatgacctctttgttgaatgccctttggcaatatctttgctaggtggtcatatatcctatgcttaagcatcatgggttctaatcttgattggtttttactattattatatgtgtccttactctcaagagatgaatcatctgattgctatctcattccctaagtgccatatagaaattatgtgtacacatgaaagccttttcgatgttcaaagatgtcctttataacttttatttatttttaaattatcttcaatatcttctcaggataaattcccccaacatccttaagttatttgattttttaaaaagtgccaggcagaggttgcggtgagccgagatcacgtcattgcactccagcctgggcaacaagagtgaaactccatctcaaaagaaaaagaaaaaagaaagaaagaaatgtctcttaagacattttctttaagccaaaaacatgaatgacagtaaaatatataaaagaaaggtggataagggaccagaaactttcattatttgtagataatatgtttctccaaacaaagaagcccaaagaagcctagggcaatgaccacgcattgtattccaggtggtaaaggatggacttttcaatcaactgagctcataaagttgactttccctattccaaaagagtctgttagaagaaaataaatgagtacatctacctcacgtgatacacatagtcaattccagatgattaaagacttcaaagtaagaagtagaacactaaaattattattaatatatttaggagaatgttttatcatttcaggataaaaaagaaaaatttttaaagaactcagaagagaacataagctttgaagtaaaagactgatattttaaattaatttaaaattaagcacatctattcattggacagcatccagttaaaaaaaaaataaaaagaacactagccataaataagcagaagatatgtgtagcatatataactgatgacagattaatccagaacatacaaagtctagtaagtaattcttaaaagacattgatctagtataaaagtatctagataacagaaacacaaatggtcaacaaatatatgaaaagaagcttaacttcattgaaatcacagaaatgcaactaaaaaccgtaataaaccccattttatattcatcagattcacacaaattaaaaaagaaaaaaatagcaagtgttggcaaggatgcaaatcaatagatattcccagacataacattgaagaaaaaacagcagcagatatatacatgtaagataaattacatttttaagaaattacctttttaagaaattaaaaaggtaaaatgattttacatgttgtttaggagtacatgcatatgtattcaaagtagatacaatgcatagaaaaaacacatttaattcagagcagtgagtaactattgagacggtgagatggggtgagagagaaggaatgccatcagaataagttaccagcaggtttaattgtacctcacatgctttaaatcttttattttctttttctttgttgttttttgttttgttttgttttgtttttgcttggtgacttttttattgtggtaaagtatatacaacataaaatttactattttggtcattttatgtgtacaattcagtggcattaggtacattcataatgattgtgttttcaatagttaaagtaagttttttccccttatggatgtgactaccatcctggaacagaaaatttgggtggacaaggcactgaaaatgattgtaacttctttaacttacagggaacaagacttggagtccctgcaagtaccctataaggggtacttgcagcatataacctttctggctgaaattacagaacagaatataaatgttattaactttttgaaaaaataaaaagtaaaatgacccagtaacaaattagaatatgggtaggagggaactgaagggtcaaggacttaataaggttatcttacaaagtggagaattaagatatactgtctatggttgttgtaatacaaaatagaggtttagatgtgctacctaaaaatatacaaatacagttactagagtaatatagccttagtattataaatatatcagaaaaaggagtaggatctaactaagctaaatctagcatagcagaatttcagtggttaatgctgacttttccaacaaaaatatatgtatatgttcaaatggagaagtaagaacagaaagaggtcgaagtgcttgcatctaaggagctggactcagggtggggaacttgatcaggaaattgtggcttttaatgataatttcttctgtttttttttaagtaacatgcttgtattctttgattaaaaataatcatcatggtatgtttagaaaactgattctgttctgctctgaatgtttctctcagatttatatctaaattttaattatttattattgacagtagtatacctattatagtattactgtaaaaaatggaatgcaagaagaaaggggaagcattttaagtctaggaagtagaataaaatatgctgcaaaaaatgttttaggtttagtattccttgaaatataattcaatcttgatgttcaagagaatttttgactgtatcagtctttgtatataatcaaacagagcacaaaatgggtacactcaaccttaggaaacttgaggtttagtaaattttccttttgtaatatcttaccaaaaatggttgtgttaattttttatgttcatgcaatttacttccaagacaaggtggttaacgagggttttgtagttgtttgacagtggaagctaaacaagatatgtctcagtggagtaattattgcttatgtatgtattagaatttatctattagtaaaaaaacagtcttataattatgtcataaaatttgattagggacataaaactggagattgtaatactattagagtgcagggaatctgcaattttctaaaaatctaattttggaatgtgtctcttttggatactaaatacagaattttttggccctagggtaagtaatcttttatctgaactctttcttgaattttctaagacttataataatcaaggtttggattgaaagcataataaattattcagagatgcattatatccttgattttataattaccgagcaagaattccagagatatgcacagttgcatgttccatatagactcctcagaaatcataccttcaacataagtaaaataacttccactagtaatttatttattttttgtgagggatggggggattaattcttaaatattaaggcattaaagtttctacaaattgttatccctgtaagatttcattttaggagtcatgaagatatattgggtagtaaacataaaattatattttgtctttgcatattcaagtcagtcctctaagtgtgattgtcatttaacttatgtaatgcataatttttcttatctctttcgagataagaaaagaatttcaatagaattactgcattaactatggagatggggtggtgattaaggggaatatcccaccaaagatatgaactgtggtctggtaagagtatggcaagaggaatagaagaaatgccactacattacttttaatgcatttcccatgaagattgtcttagtctgtttgtaaagctataacaaaatatcatagactaatttataaataacagaaatttatttctcacctttggaacttgggaagttgaagatcaaggtgctgtcaggttcaatgtcttgtgaaggtcctggtctccactttcaagatggcagcttgttgctgcattatctggaagagaggaatgctatgtcctcacatggcagaaggtagaagggcaagagggccaagtattgtgtgaagtctcttttatcagagccttaatcccattcacaagggaggagccctcatacctgatcacctcttacacacctcacctcttgctactatcacattggccattaaattttaacacctgaattttggagaggacacattctgactatggcagagattaagctgtaaaacttgactaacatacatgatgagacagttcatctattaagatttattttgaactgaagaggctttgggaactagcctagaaaatgtatatcttatataattttgtttttccaagaaaatgcaattctattttacaacaattaaaagaactttaagaaaatacttttggaatattatcagttcctacatttgaagtctctttatatgtatatgtgtgtgtagtcacatcaagtggtatatataatatgctttgtattagtttgtaagagctattatcaagttcagctagccaactgaagaaattgtggtcagcctacaaagagttgtcatgtgtattaataatgtaatctgaatgactgcagagtgatgaaattatactgttagtagttaataaagacaatagaaagtcttccatgaatgtgtattcatgacagcatgagagaataattctgtctagttacactttgaaatcctggcatgtcatagaagctttgtttgatttgttgctgttgctttcttgacagaaattcaatttagggagaaactctgagaccaacgcatctcttacctgttttgtgaagcatggcattgaatactgtcttatacctattagcaatcatggcaagaagacattagtaacgatgacacacatgcatagcatcaccttcttactttatttaaagtgtcatgcgattgggccccttagataactgtttcaaacaggtttagacaattttgcagtttaaacatacagaggctaccaaaaccactgaccataaaatgttgttctttagatcacattttttaaaaagtatccttggttatctcctcttttcaaaggcttcctttatcttcattttgttttgataatggtaagagttaattctaaatgtttttgccataagcatgtgtgtttgggaattctttgctttttacttacagaacaggcatctaattgagcaagtatgtcccaaaagatagatatgtgtctggcagtgcttgcccttcacctaagtccttgttccattagagtgactattattgacagacagcaccatctttgattcttccttgatgcttcaagactcagcaagagtcacctaattttattattgctgtttacaatttgtcccttgacaattacatttttacaactaagacacattgatgaagataactttctggcatttatactgcttaccctttgatttaattcaatccaaaatacttttgtgaaacacctactttgtgcctggctgcaggcaaggttgctctctgtctagcaggggagaaaaataactatattatagaagaataatgcagacatatgtaagatgttaatggagtgtctactgtggaaaagataaaaacttttgctttcatgggaaggggctagattggggtattcaggaaaacccctgtaaggtaatatttgatctagattttgaaagatatatgtattttaattacatatagtaagtactgtatgttccctgatgaagttctatttttcagggaatgctgctgcacttagcgtccttgagatcacacttctacttttggattagtagaaacatgaatggaggtagcattttttaaggcacatattcttaagtggacactttacagattatgattatgactctcagtatcctctttctttagccatgggccagggagccagggtaacttaaaacaatataggaaaataatacattagaaggctggagaaaatttaggagattttacttgttatctgatggctaacaccaagatccaagctttcttcactatgaagattttataagcatatatttattaatctcccatctttcaccaccatgacactctgttaaaaaatattaagaagctttgtttatgtttaggtccagtctcttttgatatcccaaacaggctaaaatcatatacttcagcatttcagcatatgtaacaattatccaaaatgactaccatcggtgattccaaggtaactgtgcatcaagttatctcagggaaattaataaaaacacagaattctgagcctaacattggatgtttcgctgcaataggtctgggctaggaaaatataataaggatttttaatatgtaatttcggtgaatctgattcagtcattttatgaaatggggcctggaagccgttaatctagattttatacacctgctaacgaaaatatacttttgaaagttccagtctgtacttgtgttttcgggggctataactggcccccaagcagaagtatcccagaatgtaaaacttattgtaacccagtgtgaggcatggggaggagggagatacaaattaataaaattcattttgagcactcataaccagttagccattttcgccttgagcaaccctggcagaaaattatgggagaataaatgtgagtgttttgtattcctcttattcaattccaattctcttttcatgtttaacatctggatgattaataacttattaatattctgcaataggaagctctcaatttatcagtgttgaaagccttactgtcaagctgtcagaattggcatccccagttgtaacagaattgtctttcctatgaactgtctcatgtcacattttctctctctccatatagatagaaagatagatagatacatagatagatttttaatgacaatttttttcactataaaacctcctcctagtcatgtaattcctttcaaagtcattcagacaagaagtctggaggctctccctaactcctgatttccagggaacccccaattcatccattccacctccagtcttccctgtatcagcaaatgacaactccttgcacctggtgctttggagaaaattccaggagtctttcttgattcttttctttgatttataccacaccctcaatttccactacatgaaagccctattcatccagctctataatgtagcctgaattaattcacttctcttcctttcctgtaacaaatcactgccattgccattgcaccgttgtctacctacaatccattatttatgcagtaacaagaggagactatataaaaactaagtggaatggggtcactccttcaatagtgattctccaataggttcaaattgctttaaataagatgcaaaatcttcaccttacctactacgccatcaatctctgacttctgcccacctctttaactatatctctggtttcacattcccacaagcccattttgatccaaacacacaggccataattctgttctttggactttgggactcattcactctggaccattgccatcctttctctgacacattttatcctggactgcctcctcattaataaagtctaagttcaaacatcaaccatcgttcactgatcagcctaactgtggtgctaccattctattctctctctcaatatattaccctatttaagtgtttcatagaacttattttttaattgtatagtgatttaatccaagtttttccctctaaaatataagatgtgtctgtcttattactatatttctaaatctagagaagtcccttatatactgtaggtatgcaataaatattaactgaataaataaaataatacatttcaaggcacgataacttgaattatttattttcatttttccaatttaaaagttcctgaattatgagaggactttaatattttttaagactcacaattattctaacaattctccttttcccagttgaatctcaccacattccatcttccacagagttgccaaagttaaatttctaaaccaataaggtgatggaccttttaccattctccaaatccataagataaagtcaaaagtcctgagcaatgtctaaaggctttttataatttattctccatctgtatttttagcttcattttctgcctcttccctttgtactctactatctaaccacataaaacttgagtagtctcagacatatcatgttatgttgtgatccatgccttcgccagtactagtatattattccttttgaagttcacttcaagtgtcagttctcccctcttcattgagagttagctgttttcacaagtctctgtcttagtgtttaatacagcatatggtaattatttatttatatgctgtgttagccctgatggctaacatagtgtgctcagcatatgtcccatatgtgtaaattgaatgagtgatggatgaatgggtggatgggtggatgggtagatgaatatatgaaagatgtcttctactaattcataatcatcgggtgaataggatcctttcccattcatctgagtgttcccttgatactgggctttaaacatggtaaagactttatattacttattaagggagtggataaaataactgtacttatttatccactgtactgtaataaaagtacttattaagagagtggctaaagtaatggtattcacatacttttacctaaagaagcattatctttgtcttaaaaagttttttatttctgtgtgttttccacctgtgttctctaactgtggaactagtagccactagttattcgagggtactgagcaattgaaatgttgctagtccaagccaaagtgtgctgtaagtataaaatatatacatttagtagaaaaaaagattgtaaattagctaggcaataacttaacatgaattatatattgaaatgttaataatttgggtatattgtcacatagacactgtattagttcattttcatgctgctgataaagacatacccaagactggacaacttacaaaagaaagaggtttgttggacttacatttccatatggctggggaggcctcacaatcatggaggaaggcaaggaggagcaagtcacatcttatgcagatgctggcaggcaaagagagagctctttcaggggaactcccatttttaaaaccatcagatctcgtgagactcattcactatcatgagaacagcacagtaaagaccctccctataattcagtcacctccctctggattccaaaagataatttatttttaattttggaataggtccaaactttagtatcagaaaaaaaattctctagttttctttgtttagacttcagctttatttaaatgttttactttgcattgtattttatttacaggctctgacatacatgttttgaaacaattatgattttccttttattattattattattattattttaagatagagtctggctctgtcacccaggtgggagtgcagtggtgcgatctcggctcactgcaagcttcacctcccgggttcactccattctcccgcctcagcctcctaagtagctgggattacaggcgcccgccaccacgcccggctaatttttctattttttttatagtagagacggggtttcaccatattagccaggatggtctcgacctcctgaccttgtgatccgcccgcctcggcctcccaaagtgctgggattacaggcatgagcaactgagcccggccctaatttttattatttttgtaggaaaaattttgtttttgaaatcatatatatatagagagagagatatatctagagagaaagagacaaatacacttttttttcttttagttgaaagttgtggttttaaaagaatctgcttacttacaaatatttacctagtaaacattctaggtttggaatcacagttatctaggggtacaagaggaacgggggtcgggcgcggtggctcacgcctgtaaacctagcactttgggaggccaaagcaggtggatcagctgaaggcaggagttcgagaccagcctgaccaacttagggaaaccctgtctctactaaaaatacaaaaacattagccgggtgtggtggtgggtgcctgtaatcccagctactcaggaggctgaggcaggagaattgcttgaaccttgcagtgagccgagattgccccactgcattccagcctgggtgacagagggagactctgtctcaaaaaacaacaacaacaaaaaaaaaaaacaggaaggggatttgagaggttaaggaataagtctaaggtcaagaacatggtcgtttcaccatgcatttcaccgtgcaaatcagcaatcaggatttatttatcaaatttgatcatctttctcatctctgatatcatgccctgttctagagctttactactttttaccatgataatttcaacaatctcctgttatccttctctccattgttgtctgcattaaatccatgttccacactgctaccagagatgattaaatatttataatttaaaactatcactttcctaagtgagagcctttgttaatcactaactatgaccccattaaatacagggataaagtctaaatccctagctaaggtgtacgtatccctgtgtaattgaaatctggctacctccaatgtcgtgtcttgtttgatgcctcccctacctcctgctacatgttctaacaccaatcttgtcttcctcattctcatctccataacctgctcttctccacttgcctttgctgtctccttttgttgctctcctattaataatctgttgaattatgtatcatttccgtacccaattttattatgaatctgtttattataaattacccaacaagactgcttgttctgtaaggcagagatcttgccttattctctgtggcttgttttcctcatcagaaaaatgagaatgactcattacttacattgtaggaggagtgagttaatacatgtgcctggcaaataatcagtggtcattaaatgttatatcacttaacataattattgtaattatccatattaatagtaatttgttaagcactcagtaatgtgtatatagtaaataaagatcaggtgattaattatatttaggatcccaggaaaaagggacagggaagaactgagttgaattaagaaggaaaaaattcaaaaagcaagcttgagaccagaagtctctaactggaactactgattcctctgccctggtctaaacctttatcattcagttagcttacatgctaactgtctcctgaggagtcatttttcatatattcattgcaagttccctcagagagcatagtattagatgatgtcgcataggacaaaggcaacatatgtggctttggaataggacttttcaatgtaccctcttcagcattatcctgatttacttcctgtaattctgcactgctaatttggctcttttctatttcaataataaatacctaggggatttttttaagcaactaagaaggatgttatcaatttttcataagttccagttagatcaaagaggaaatctatcatgtagttggtaaaaacaaaattaaccaaaaggtcattccagaaaaagctgtaaaaagagcaagaaaaatatcatatcacttaattggttatgatttaagtaattaacttgttctttttgtctggcactaatgatattcagtaagcataatatattgttataaaacagacctagttcttgtttttttgagtcattatgagaaaagcagaacttagagtcagaaaactaatctgcatattgcatttgtatacaaataaatatattttacataaaaataaatgtaaaatcacttcatacatattgctgctaatatgtaatgtagtgtgtgaaatctaatattaggtaatagttactgagaatctattttttcctatgtaattgtcataatgatctggagctcaggttgtttcctggagtcatgcagtggcagaaccacaaaattcaacagagatctgtttgaccctggaatctgatatctgaagcactgccttgtcttattttaatcacgttttgcgtgtctgtgtgtgtgtgtgtgtgtgtgtgtgtgtgtgtgtgtgtgtgtgtagctaattgaacttttatgcctagaacagtgctggtctaacattagataaggatcatatacttttattacctcaaatgcccataagtatcatatttttataatcacttatcatacttcagctacccaatctctgaaagtatatatattttaatcctgtagaatatttttataatgagatccatgtctgtattaccttcattgaagcacaaagaagtagaaattctttttatttcaattaattttgtctctgtcctgctgcaagagatacctacaataatggtatttaaggattcagtaagtaggtctgtatttcccatttacaatttctgtatggctttataaacattgaagacatcccttctaaactgccctaattccagatcaaagactcatcttcagtgtttttggttagaacaacaaaaacaggaagaattatatttttcttaaaaaaaaaggtgtttgttaaagttcagggaaaaaagagaaagagtaccaataaatgagagcaagtgatgtttccaactagataaaatgagaatatccaaatccttcttaaaagcaaatttaattaaatctgaggatacagtggggttttgtggtggtggtcgtggttgacctatttttaggtcacaaatctcagtggagaatgtaatgaaagctaaggattttttcttccaagcaaaatgcttgcatgcaaataaatacaaacttttttcatgatatttcagggaatagggcccaaaggatggaccttaggttaataacttctgactgaatctataaattaggattcactttactgaattgaattcagttttcactatctcctgctaatgattgtgtcttctaaagctataacatgttttactgctttaccacttgatgtctccacctatcatttacataatgctaatgctatttcatctctctaactctgctagacatttttttcattaaaagttttagaaaacatccagacttttaagaattgtcccacatgcctactacgttatttgaacattgtctcagaggaattatttcatgttccctttttaaattgttaattgacaaattatcatgtatgtttttgtgaggtaaattgtgatctttgatatatgtacatatgtggaataattaaatcaatctaattaacatataaaccacctaaattacttgtcatgttttgtgataagaacatttcaaatttaatctcctagaaattctaaaatataccttatttaactatagtcaccatgctgtgcaacagatctcacaaaaactatccctcctgtctaattgcaactttgtagcatttgtctaacatgtccccttttccaccacctctcagcctctggaaaccactgttctcctctctgagtttgaatgttttagattccactcataagtaagatcatgtggtatttgtctttctgtggcttgctaatttcactagcataatgtcctccagattcatgttgtcacaaatgacagaattaatttattttttaggtctgaatagtattccattgtatatttataccacattttccttatccactcatccattgatggacactttgttcgatatcatatattaactgttgtgaatagtgatgcagtgaataagggaaagagatatctcttcagcatgctaatttcgaatcttttggatatatacccagaagtgggattgctggattatatggtagttctatatgtagcttttgagaaacctttatacagtttctcataatggctgtactaatgtacattccctccaatgagaaaaatatgccttgaagccagaaagatcctgacacagttaaggaactgaatgaaggccaatgtacctactcatataaattactgggagaatgtcagacaatgtggtttgacagaaaggcatggtccatattacacaaaacctacagggtcctatttaagagttgtatttcatttaaatataatgtgggacacttaatggtcttacactggagattgatatgatcataatttaatttttaaaataccattttgaaggggtttggaaaaatggaatggaactggcaaatatggtggcagataaaccatttaggagattgtttttctagttctgataagagaattatggtggttttagctaagaaagtatagtgatgatagataaaagaagatggaatcaagatatatttagggagtagatttgatagttgggaggtggacgcaatgttagaaatgactcttaggtgtctagcttaaataatttaatgaatgtatgtattattattagagatgttgaaaatacgaagagaggcaggattggtagttcaattttggatatgttaactttgagatgcctgtgagacattcaagtggatatatctaatagttcagagtagaaactagggctttatatagaaatgtgtgagttttcaacatctacactcatgcattgcttaacagtgggaaatgtgtccttaggttattttgtcatgcaaacatcatagagtgtacttaccatatagcctattacacatctaggctatatggtatagcctattgctcccaggctacaaatctgtacagtgtgttactgtactgactacggtaggcaattgtaacgcagtcatatttgtgtatctaaacatatctacacatagaaaaaggtacagtaggcctggcgcagtggctcacacctgtaatctcagcactttggaaggccgaggtgggcagatcacctgaggtcgggagttccagaccagcctgaccaacatggaaaaaccctgtctctactaaaaatacaaaaaattagccaggcatggtgatgcatgcctgtaattccagctacttgggaggctgagtcaggataatcgattgaacccgggaggcagattttgcagtgagccaagattgcaccattgcactccagcctgggcaacaagagcgaaactccatctccaaaaaaaaaaaaaaaaaaaaaaaaaagaaaagaaaagaaaagaaagaaaaaggtacagtaaaaatgcagcattaaaatcatatgagaccactatcctatatacagtttgtccttgatggaaacatcgttatgcagtgcatgactgtaaatggcatttaaagttatggtcctagataagatatcccaagaagtgagtatgaaagtggaaaacagaaattcaatattagccttgaagaggtttaaagcatgggtcaagaaagacaaaacaaaaaagtaaactaagaagaaatgagggtaggtcatttcccacagagaaagggtaggtcaagaaggctgtgagaaaggagtggtaatctgtgagatatgtaccaaagaaaaaactaaaaatattgtccattgagtttggaaaattgcatctttggtgatacactctccaaagaaactttactagcatattaagttgagaagccagattgaattgtgttggaaagagaatgagaagaagtggagacaggaagtgtaggcaacttttcaagaatctttgttctgaatgtgtacaaaatgttttgtggcaggggtgcagggggtagggggtagcgttttgaagaaattcaatcaggcatttttttttttgagacggagtcttgctctatcgcccaggctggagtccaatggcgaaatctcggctcacttcaacctctgcctcctgggttaaagcgattctcctacctcagcccccgagtagctgagattacaggtgctcgccaccacgcccggctaacttttgtatttttagtagagacaaggtttcaccgtatttgtcaggctggtctcgaactcctgacctcagatgatccacccgcctcagcctcccaaagtgctgggattacaagcgtgagccactgtgcccagcccaggcaatttaaatgtacattcttcttacctttctctctcttcctcttgcttctttttcttcctattctttttctccttttctttctcctcctcctatcccttttcctcaccttctcttctcctcccactttcctttctccttcctctccctgttcccctccttcttccccccatccttcttctccttctaaggcaatggatactaaagcaagtttaaatgcctagagaaataatctggtggaataaaaggaggttgccagtgaaggtaatataatcccttaatacaatgtttttttttttcagacttgtgcattttttttcactttgatacacacattttattaatctcaatggtagaaatagaataggatcgatctcaaagtgttatctggccttaaaatatacagaaaatgtaacattcatttgggatgtggaaatcaaaggactgagttagtgtttgaagatcacttttagaatttgacttaaaaaggaagagtggctatatttgccttaaagatgaagtatgaacttaggaaaaaaggaagtcaggtttttgttcatttgtccatttgtttttgagaaggttctggctctgtcacccaggctggagtgtagtggcacaagctcagctcactgcaacctccacccccaacctcagcctcagtggctggactactggtgcatgccacaacaccccgctaatttttgtatcttttgtagatatggggttttgccatgttgcccaggctggtcttgaactcctgggctcaagcagtatgcttgccccagcctcccaaattgctgggattacaagtatgagccactctgcccagcccagttttctttatattgaagttaaggtggtcaaatgactttgaatttgaaagtaaatgttgcagacagactaatggaaagcagattgtacatatgaatttataaaccatatttatgaagtcagttccaagttaatataacagatatctggaagatagcagattagaaaataaaaaggactagatgggtatgaagaatgagtaagagagacagaagagaatcctgcttagagagtgaaaaaaaaaaaacggaatagacacaggcagacaatatgattttggatgtgtatatcacaagaggagatggtggctgaaactaaagcttggaagccatttttctgaaagaagggagtgggaaatcatgtttttataacaagatagataatgcttcaataacaggattgatgagacgaataaatatttattcattattgttaattttgtatttacctaaaatcaattctcatgttagaatttattcataattatctgataagagttagagtaatagtcattctcacgtacttctcttcatctgttctgctcctcagtatttttcttcttaactacacaaacttttcattgtattctcatttaaacaattttgacatcaacttttccagatctctttctgaggtccacctgcctactagaatattccactaacgtcattataaaactcaccaatgatgtaatgaattattgataaattatcataattgatgataattgataaatttcacttgtgaatccactgtaagatcctttctcagtgactaactctaccattgtctgctcactaacacgaggcaccaatagtcaatcctttcctctttctgacaaccaataaccaatccttcatcaaatgctgtccagtcttcctctttgttctaagcttgtattgaatccaaatggattttccatctccttggtttccaccctcatttattacatgttatattaaaacattctacctagtgatccacctttgcttgttgtactattgttgtatttgcctctcattctcattcccttcttatttaaacaacatcattccagttcataattaggggaaccagcctttccctattgatatggtttggctctgggtcgccatccaaatctcaccttgattgtaataatccccacgtgttaagggtgggatcaggtggagataattgaatcatggaggtggtttttcccctgatgttctcatgatagtgagtgagttctcatgagatctgatggttttataaggctcttcccccttcactcagcacttcttcttcctgccgccatgtgtgaagaaggacatgtttgcttctccttctgccataattgtaagtttcccaagacctcctcagccctgtggaactgagtaaattaaacctcttgcctttataaattactcggtctcaggcagttatttatagcagtgtgagaacagactaatacacctattatcagtgtgtgtaattggagtggacttgtgctggctgtacccttaagagcagtctgtttccctagcacaatgctggattcacagatgacatgaataagatgatctatgacagcactcactcaaactttgattttggctgttggggaaaacaatatttttcagaggtattgctgagctgtgtagtatatgtaagccaaaagtttctggtggttaattctgcaaccatatttgaagagaaaagtcaacatagaagaaaatcaaacctagatgagaagacaggcacttgacagcattgtttgcacacatggatccagctgtgtacagagctctcactctcccttgactttggaagttatatgcgccaataatttccccttttatgcctgaactaatttgaactgaatctctgtcatatgtagccaaaatttttaatataccacttctatatgttgaccttccaatctagtttttactgccaccagacaaatatttctaacatagaaacctggttatcaaacccctcttgctttatttgcataatagagcccttgggataaacacagtgcctcactgtgacctgacagataccttcatgatctaacctttgacctacctttccaactttgtctcttggcactctccctccaccacatttgtccactcattcttctaagtattcttatatttaatttgctctgcctgaaatgtctttcttttccagccaataggtagtaactatttgctctcctttactcatcaggttttatgtttaaaacccttcttcgtatccggtagctcttggtacattcctttatgagaccccataggatttatttctctttctttcatttaaacttccataaagagaagaattttttttctgaatctccagctcttaccagatcatttggtctattaataaatgtttacttaatgaatgcttggaggagcaaatgaataacaatctttaaaaggctaaaataataaatttacagtgccttttcaatgggagcaggttagaatattttgctgtgcttcagaagccttgctcatttaaccttaggcatcagagtctcaagttttagggaaaacgaactcttatacattttgtagttagaataaattttaaaatatttatatgaaaaaagattatattttagaaatataaaacaaattaaataataattattttacatttgatattttctttaccatttgttaacttacattacagtgaatgtaggcatctttcttacatattttatttttgatatatacacacatatccttttgagcttcctgtacaacacatcttatgtgtagtaatgtctaaaatattaatgctttatttaggtttgaaaactccccaggaagatttgacatttaagattagattcagagtgtattatcatgaacattgacagctgagagtgtgactgaagggtctttgtccttacaaactaaaagcctatttatagtgcttaatgaaacactagaaagccattttccttacatgtttctatatacatcattctctacaaaaacttgattggttgtgagtatttttatttaacaaaatttaagacgttggtgaagatgtagttgttttatagatcccattttctcaatacgaagcaaatttcttgttaattttttattgattataacaaattatgaatgtgaaatgtacatggcttgcactcgaaaaatgcttcagatattgcccatctttttattaaaatgagattaaatcaagatggtctaaaatattataagtttacttttctttgttcttaatttaagacaagttagaactttcaaatgaaccactttacatagatttatattcatgcccatctgtctgcatataataattaagaaaaaatattaaaatgattcattttccctactttaaaattattttaaaaggcaaacacttcatttactttcatttctctctctctttttttttttttttttttttttttgagacagggtctttctctgttacccaggcacaagtgcagtggcatgattatagctcattgcctcaaaatcctgggcacagcctcccaggtaactaggactggaggcatggaccaccacatcaagctatttttttttttttatttttttagagatggggtcttgctgtgttgcccaggcttgtctcaaacctttgacttcaagtaatccttccgccgcagcttccaaaagcactaagataacaggctgagccacctcactagcctcatttctctttttattaaactactcaagttgcttcttacaaaaagacttttatattctctattattggggatttaaaaaatataccctatcatttgccttacctcttatgaatgggattcctgaagaacatgacaaataacaaataaaatgtaaactccagattccagcaatgaaattctcattattttgtatataattcacatttaacttcttattttgaaacatatgaatgagcaaagtactatttctggaggggactacatctggccattcatttagaaacctgcctaatgtgtttgaagggaaaataaaattgtgtaaattagtggaaagaaaggttatcaacaacatttttttaagtttatgttttaactttatgtatcatatgttctattctaatttacatactttttgttttgaatgacatcaaatgatgttatatacatcttctggcacttgttagcctcatgagttttatagaccatgctgacgttgttgatccccttatgtatacaaagctttggaaatatttatcaaaaaaggaaaaaatcttcactgaggaattagcattccagtgacatgagaattatgcaatgttaagattaaaataattttcttttttcatgagtaatgcatgcttatagttataaaaagaaaataaattaaaactgcatggaagtatataaagtgggaagtaaaatgaaaaatatgctgtcctcacaaaacatattttaagatgtattttcaaaagagtgtgtgtgaacagaatttatatgcacttaatcacctctggacttagtttagcaatctacgcagttgtccggaatgagatctaggtaagcagtaagggtctaggaggcttaaatgacaggaaaagatcaggattatcttctgcaagatatccaacaagcctatacttgtgagatcatgaggacatttcagtttccaggagaccaatatatcacattagctttggattgatatcagattccaggaaataataatatcaatttgacaaaacagctagtcaataaaagggcaaatatgtagttaagtgaacccagagaatggtctgactttcatcagtttctcagcagtgagcctgagcattaacattcaatcagtgttacatttactgtttcctcaaaggctttgaacaggtgattccctatatatcctagaatcagcctttgacagagatgtgacagtaactacatttcctcagtctccaaaccctccttctctcctgactcttggcctgtgaacattctcccattgtttcagccatctaaagaggcaaacaaacctacatacaagaaatatgccctcccttcacctccaatcctcctccagatgttgtactattcctcaccttttcttaagagccattgtctttcaaagagtgattgtctttattcactcatttccaatttattactctacccactgtaatctggtacttgttttccaaaatcattattggtgctcctctcccaagtgtcacagagggcctccatgttgggaaatccagcaggcctttcagtctttctcttactgtgtacttctgactaagcctccatcaaatcactttatcttgaatcttagccatattttctcagcattacgtttcaagctcctccataagttcctcttttgcctttcataccttaaacattagtattcattttagatacacatttcttatctattatgcctaattttgtgaacaattgtctgttgattttccattatctgtctaaacatttgactaattccagagcttcaaagtcaaacattttatcttttgtatgacatattgtcttgcatctaaccaagtcagagtgtgccctacagttatgcctaagtgctctcttttgactctcccatatcggttcctcattgggtatctcttatctctattaattataattgaaaatctggagtaatctcaactcctctgtatctttcaccagagttcaaaattaatcaccaagaatctaatatctcttaaatgttttcttaatttttatatgcttcctagcctattttaataatgatgataaataagaactattttaataatattagctaacatttattgagtactgactacaatgcaggcactgtgacaagtgctttacatgtattcattcatttgatctcccctacattcttatgaggtaggtgttattagtgattacattttaaaggtaaggaaattagtcaaaagatgaataagtcactttaccaatcttctaccccaagtaaattagagtcaagatttgaattcaggcaaatctggtgccaagcctgccttttaatctccttacctttctccattttcacaatcttaccattcttcaatcctaaatgtacatgtaaatctttctacccatattattttcaagcaatattcatactatctggaaaacacattaatagtatattgtgcatcactggcatgcctcaagttctgtttttaatttcaaaggtgtcttacaaattcaccacttcagctctttgtttatgatgaagtaataacttaccaacccaatcctgctccagttgagcagtcttcagaaggcatgggccaggggtactttttgggaatggaactattaaagtaccagaatatctttgtgatatctagcccttaatgtgccatggttaggtcctattccctgatgaagaatgccagtctccacctgggaagtgatcattcctagcagacattatgatttgcagaagctttaagggctgaagccttcagtctatggacatatatgacctcagatgcctgatgcacagaaacagggagaccctcagcagggagcaacctaatttccggtaaatgaagaataaggacacatatcatatatatcatatataacttccagggcagatccaggtgtgttgtgcctcatacttaaactaattggggatattctttaagaagactaataaaaactctgaatataaaattagatacagggtaccaaatgggctatgcaagcaatgggccctaatgattgagattccttggctttatggacatctacctctgtccacttcaatgagtactagaatcatgttgacgcaatttccctcatgagtaaatgttcccatatattccaagtacaaattttatccatgagccataaatgaaatatttggatgtgtagtaaaagaaaagcttaaagtcatttgtagagattagaaagtagagaaagaacctgtaaatagatgttaagattagtaaaaatcttggaattcaaaagactgaagagaaattagttattctgatgacataccaaagaactaatcgcctgcttttcagtatattcattctcagcaattctaaagtcatgttctactaggtcttaagctcttaaattaatttcctgactttctgttcattttcacttcaaatcttaaaaatacatgtgcacatatgcatacacacatatttctgaagaaaagaaaagttattttaacttacatatttatattatgaacttgggatagaagctgttaaaatcttgatcttgtacaaattttttttatcatgggtttattattttgcaatgccagtaataaagcaagttgtcataaaagtagtcaacagtgaatcatcttataacaatcaagggagtaggtgatacttattaaatcctagtttttaaagacattatgctaagaaggcccattgtttataacatttaattaatgaaagattgcagaagtttgtaaagtttaaataagacacttgtgctttagtttctggcccaaatacttgtcctaattctccagactgtcacctttttgttttagatgagcgcaaagaaataatggcattttatagacagaccaaattaaattatattaatttgtttactcacattttaagcacatagtgcactggggcttagaaagataaaggaatcattttctctggactccaaaagcttctaataggtttttaccacttaccaatatattaaccaattctttccacctgccagaatattctagtaataaaatgcacaaattagtattgtcagtcaattaacttagctttcttgaatacaggctgttacagtacttgttgatgcaaacagaaaaatgcaaaaatgagagcctgctttccttatcatacgaataattattaatagaaatagtaatgtttatttttcattgttatatcatgtatattgtattagacaataataatttttaaagtgaatgatcctcaccactgtgttcaaagccagcatctattattattagaattcttatttgaataactccttgacttagtaattcaactaattacattgttttgttttgcaggtagatatttcttttgactgttggcttgaggttgattttgttccctaaaattagaatctgtaattatagactaatgtaacatttgagatctaagacagcagtgatcttgaatttgtaataatttgacaatcacaagtgcagtaggttctccttagagaatgaaaggcaattctatttgaggcttctagtaacagattccaaagacaacttgttcctttctgcaggatatggaaaaaggagttagagttcagatactaaccctattcattactcttgaaatcttccttctgacatggaaattctcttttagagcacagcaattgacattcaaatgaagtttgttcttttcctcaatgaaaacattacttgtttatcttattatgaaaattcatttgttttaccgttcattaatgtttgaaatggggcacagagtaggctttcctttttcccaagacaccacaccactgtaattctcaaagagaaatggtggaaccaccccaacatttctccaaaatagttttcatttcttttatagttgcttgaattccagctctatttgttatattaggaaaaacttaaaatgctatgggtgggtgcatttttctagcatttcagaaaatgcaccttttaaaaaatatttttttctcaccatttattctttacataccattgttccatttctgcctgctctttttgcacaatttacaggttgatccactctccttaggaaagaaagcattgggtattttgtctacagatcctatgtaagaagtcttactgaaatcaaataatctagataaaatttaaattcctaaaagaaagttataatatcttccacaattaataatacaaattattagccaatgaggcagatctttgaaatgtttccctacttttcctcatgagtactattttattttcattgaaactatattctgatcagccaatatcatgaaagataaagaggcttttataagaaaactgaatagaccttaacagaaaataaaacaaagtaccttatattattttaatccctaaaattattgttgataaaacacagaatgaattttgacctggcctattccttttgtttttaatctgttatttgtttcataaaaggtgaactgtgtagaacctttgcattttatgggtacatttcccctacagtagctcctagacaccctgaagaggcaaggtcagtgattggagaattcagagacttgaattctggtcaaagcacagcctctagctatttataatacttttgtcacattattttccctgtttgtgatgcactttccccatatgttacctcctcaatcagggacgggttgaggatttatgcatgagttcatggagtaagttggattcgaaagagaagcatcattgaagtggtacctgtgattggtgtcaacaaaagagagacaaactttttcttttttaattctgctttatttcaaaaggatttaaggacaatataagctatgctgtttaaataaataatgaagtagaataaattaagaaaaaaatgccagctctagttcagagttcacgtgtagcaagacaggaatacttgatttaaacatgtaacttctatttattaaaccaaaaattatagctcttggttaaattatttgaagatagaatctgggatttctttagcatataaaactataaaagggtccacctttaggtatgtaatcaagtggtcttaaatcttcaatatgattttaaaggagaaacctattattttgatattcaatttatttttcagcccttttcatagaatacagatgtgaaattatttaataatacaattaaataaacacacaccatgtttcatacagctaaatgtaagagatagcagtaacatataagggcttctggatagatactgtatctatttgggagtgattaagttcactattacttttcactatgttattgtagatggaaagctgatccactttgttgaaatttattatttattttcttttttctttttcttttttttttttttttttttgagacagagttttgctcttgctgcccaggctagagtgcaatggcaggatctcagctcactgcaacctccgcctcctgggttcaagcgattctcctgcctcagcctcctgagtagcagggattacagatatgtgccaccatgtctggctaattttctatttttagtagagacagggtttctccctgttggtcagactggtctcgaataaatttagtatttcacttttaataaatcatttggaaattatcttatctcaggtaaaagtatttgtcacctgggattttcattcttcagtggtaatagctgctcttaactaacattacattgaaattaaagatagctatatttaacattttgatattgattgcagtcagtaaggcatgatattttatattacatttagcaattacaactgaagctcagggcatttatgaggtgttcatgatgggaagggaggagttgacatatggagattactttgacttcagttattcattgcacttcagaaaatgcttagtaataaggtcattcttcagaattttaggaaaaaaagaagtttacattatttatttatttatttgtatagcgtatgtgtgtagacagatagaaatagagaaaattataaaagccctttataaaagagtatataccttatgatatcatggcaaaataattatgtggtgataaaaagcaaataagtcgttgattcataggacagaaaatttcttgtgaagaaatgtagctatgataaatcttcacattttaataggagtttaggttacacaagtgtaagcatttatcaaaacttaggaaatacacatttaagctatgtgcatttcatggtatataaattttacataaaaatactgaaacagaaatcaaactctagttaataaagcacacgtcaaaatttagggaggagtgtgcctatactctgataagcataaaacattcgatggatcagaatgaataaaggggctcacaagaaaaaaacatgctaaaatagctaggaaagcaaagaaaaaaagctacaagggagaattcgtcttgctggatattaaaagatagtataaagttttataattaaaataatgccatagaggagcatggatagacaaaatgaatgaaatagaaaatatacagataaatacaaaaataaatggaggtttaatatatgataaaaatgacaaatcactcttctaacactaataactgatgctgaaacaactggtttatcatttgataaaagatataatttgacacaaatctcacatcagaagaaaagaataagctgcacataaatcagcattctaatgtttttgaaaaaattatctaaattcctcttaaccttggtggaaggaaatgctctctgtctgtggtgatactgcacatgcaacagaagaaaatattgatacatacaacattttatgtagcaaagcaataagttaaatgaaaagacaaacgtcaaactgatagaaaatatttccagatatgtcgcagatggagtgctaatatcactataaagatctctaaaaaattgatagggttcaaagcaagacaagcaaataaacaaaaaccctccaacacaataatgaatgaaagactagaaaggacattcacaacacacatggagagatagatagatagatagatagatagatagatagatagatagatgacagatagatagatgatagatagatagatagatagatagatagatagatacagagactgagagactgagagaaaattgacgtttcacacattcaaagatgtttgacttcattcttaatttttaaaaatgcaagttaaaactgtactgagatacgtttattcacctagcagtttgctgaaaactttaaagtatgataacacgttctgcttgcaagtctatgggaaaaccaaaactgttcacacattgatgatgtgaaagtaaactgcaacaacccttgtagtgagagatttggcaatacctaataaaactgtatatgaatttacctttcattcagcaatttaatttctaggaatttaccctcaagatacagctccaagtatgtgaaaaaatacatgcacaagatatatgttaaaggaaatagttatcaatagatgacgtaggtacaggagaaaaacttcttcgccctcttgaaggtttgctgaaaatcacagacaaagggagattaacaggaaagaaaaggcatacagttttattttatcatagttttacgtgatatggaagccttcaggataaaagcccaaagatacaggggaagtttgtccatttttatgcttagattcaacaaagtatgaacagctgtgtagaatatgactggacagaaaggggtacgatataatgccaatacactgagtggggaaacacaacaaaggctgtctgtctagatttttacctctctgtgcaacagtccttccttatgggtgtggggcaggaccctctccagaatggggatcttatgatctgtagttaaacaatgtaggtcaaatattttcttgatggacaatttttacacaaaaagttaaagggtggggagttagaggaatatttttaggttttgtgactggctttggggaaacggggttctgtttattatgacccaccttggaaaagagggattctggctagccttgggggagaatgaatgaacagagacaggagggcaggagaaggtcagagaaaatcttttattatgaagcctttgttttggtgtatcgttttctgagctccaataatgatgtaactagtgagtgaaattttgataaaaattgaaaagtttacaaattctcaccttaagtgatcaaagttaacattagtaatggcacaaatcacattctctgtcaacttctatgatgcactaaatacacagtatcacttctcttgcattcttgtcaaaaaatgcttccctgaatgtaatgatgtgtaaataccagacaaatctctcttcctcccaaaatgatgttcctattattgtcatttataacaatgattgtacttaatgagaataaaatacaaagagaaaaaacaatgtatttattctttaaaactgtgcatggagaaatatgcaagaagagaaatttatgatgcatataatcttttaattgacacttaatttagcagcaattaaaccttgcgattactatttaatattttttaaattttattttagtaggtaaaacaacatgatttctctgctttaattttttaacttatttcacacacaaaactgatattaattgttcttgttgatggatttaaaatgtttttgtaaatataacaagtagtatttaagtttttatgccgcaagaacaaagttgttccttgaaacatttctttagtgtcagaaattcatgatattcaatttcagagtattattaaataccatttatattgattttatatttattggcattagtatatagtgctatatagttaacaaagatagaaataaatggaaacagtatctattctcacaaagcccccatttttgctgtatgcagagagacgctcctcattgaccctgctcaaataaagtgcaattatctgcatgactttctgctccacttcatctaaagatgcaactgttcctctggcaacagaacatatcatctctcgtagtcagggtgatttaaggacttctaggctcagtacattcatgcagagtgatccagtgtgtgtactgcacaaagacaccagctgaagaaatgagtgggtgcactctgctgatgatgtggggaggggctgtctcactgagaaaagggtgactttttctggatacaaaggcttcatttgcttttaggtttgtgatagcaggactccactggctacctggggcacatttttctttttttctttttttttattatactttaagttttagggtacatgtgcataacgtgcaggttagttacatatgtatacatgtgccatgttggtgtgctgcacccagtaactcgttatttaacattaggtatatctcctaatgctatccctcccccctccccccaccccacaacaggccccagagtgtgatgttccccttcctgtgtccatgtgttctcattgtttaattcccacctatgagtgagaacatgcggtgtttggttttttgtccttgcgatagtttgctgagaatgatggtttccagtttcatccatgtccctacgaaggacatgaactcatccttttttgtggctgcatactattccagggtgtttatgtgtacctggggcacatttttctaatcacacaaaaataggctggttgtggccttcattctagcttaacccatttcccgtttgcacctgcagtactcaccagtggcgcttgtggctgtagcgtttaccctgagataactttgccacgaaatatctcacttttattattatatttgcatggctctagtatattgactttggaaacaatagacatcattctatttattgaattctgtttttagtagtggtatttccatttacaaaatatggtaattctcaatcactgtaaatgtcaaatcctagaaaacatagcagtcctacgtgtgatgttaacattgttctcaaacagtttgctggctgaagattcatttgatgaatccaatttttctgaaatagatgattcttatgattcagatgattctgatgttagttctgtttagaaataactccaagaacagtttttatatttcattttcccattaaaaatcagtcagatttgcctcagcctcaaagagcgtgtttatgtaaaattaaatgagcgctggcagagatctacactttttttttccccctaaatgggaaagggttaataagcccatttttacatcttaattgaccctatctctttaggttactgctttggtcctgagctctagttcccacgttgcactgtgatccatgaactgattctgtgtcctgcacttttgtatgaatatcttgctgcagcaaaatcagaagccctgtttctccatgagggaattattttctctgggactgtgatctatttctgaaatcgtcccctggatgtggtccctgctattgttactgaaacactagaggtttgctgtaggacctgctgctcaccttgcagaaagccaatgactgagaagattaatattgccaaggaagaaggctttaattgggtgttgccaccaaggagctcagtctcaaatctatttccctaactgactaaaactaggggtttttatagaagggaagaaatataacaatgtatgagaaaacaggaactagggaggagtaaggaagcaagcatgatgaatgaggggtctggaatctcattttcaggatgtggtgatctggtgagtttcagttctttgatgcttttttttgagaggcttgaaggtcctttcctgaggaaggaatttagataaaacaaatataagtttcaagctttaagatcagaaaggtcaatttctatgtttatcaaatggaacagttgatgggactatttgggtcagtttcactacctgctaccaaactctacaaataccatcaatttatctgttagtatctcttcattgtgcttgttgctgtatacccggggcaagcctcttgtcctttgccaacactgggctgttcttaatgtagtgtttttcttggcacttcagttctgttgcattcttgaccaaaaaaaagaaaaaaaaatgcttctctgaatgtaatgatgtgtaaacaccggacacatctctcttccttccagtcatagcttatcctaatttactctggatacagagcttcaattgacaatttgactttcgttatcaataactacatctttcttcaagattgtatggcccatagccaacgtatgtttagtatatactaattctcaaaacttttgctgagtatgtaattttatatatatatataattttaaaaattctatgggtgaaaagtctcattagaagaatcctaagaggaaatggatcttttcagagaatctttcatattttgcactgaaaacagtagttacactaccatcaggaattttccacacacttcagaatgacttcaacctctcagtgagtttaattgcccaatatcctatttatataagaaggaaaggcgaataaatatataaaatttactgggagatgaggagagggaatagttgaatgccaatggagaaaattaggatttctgagaggaagtgtgacttgaggcctatcttgggtaatatacgtgagttctgcatgaaagaaagcattccagatagaaggcattctacagctagaaagagttaaaagcatgagagggctttgttccctgaagaaacattgatatgttcaacattgctgaagagttgaaaggcaacagtgaaaggaaaagataacatgaggtgaagctgatccagatcctgtgaagcctttagactttatcattaggaaggaagagtcatcaaaaacatttgaataaaggagtggatgttttagatttgcgtttttgtctgccatgaggagaatatattttgaggatcaagaatactccacagatgcactatactgattccatgcaataatttaagggcttgttgattcatgatgtcagcatcaccattgtaatgtcaacatcaaagtttctggctttgaacttgggtggatggtggtttcattgtctcagagaggtaaaaaacatgagcccctgagtggtcagttgactgggataagaccataaatgagagcagaagcaaagcccagaccagagtccagacctgctgataataaaatccagtgttattattactaacaaaagtaaaaatttaacttatgaattgcaggaggaagtttgctgcaaagtcactttaattacagttatcacaggcaataaacttatttattccaggcaactaattgttaactacttccaatagcatgaaagaattatattcagaggttacataaagggaacaattccaaaaattcctgttccaaaacaacaaaggccacaacatttacttggtgttcttttacttttattatcatttatttccaaaattcaagagagttcttcacaatagaaagaatataaaacttgcttgcataatactgtaggttatctccctcatttttacgtgctagataaacagggtgttttaaaattattgacattgtagaaataactccaatggtaatatatgattgttatttatttaatagaaattatattcatgacattttatttttaaaaataacttagacatcagcctagtgtaccctctctgttaaagtccagatgaggtccactgaaaccccagaagaattatctatggatgttcagagagccatgcaagatttattcagttctctggtagacttaagtgttttgtgactgcttttgttactgctttctctgctcctcacagttcaatccagatactaaatttggcttttttctcacattaatgacattgccatgacattgctaatataatgcatttattaataggctaaatgcagtggacaataagagaggaggtgggcttgtattgcaagattgtagtgaaacctgaactttagacaaaactcatttttagatttcctccagctatcacaccaccactgaggagctcactggcctttttagcttcacatcatttgacttgctcctttcctcatcatagtctctttttactcctttctttagttttccctaccttaagcccctaccctcctggaataaagcaaatattccccttatctcattcaaagcagctatttcctcggtttcctggcaatacatacctccttaaaagaaattcttcctgtcaaaggcaatttctttcataagtgggttgccagtgctagttgctaaaataataatgtgtttactttcttaaataacctatctgtggttatgatttaaagacatgggggcctcttcaaagcactcaccttagaagaactcatgtttctattgatgatgttgctcttatagatggattttgttttgttttgtttttattttgggttgctctttcattactactctggtgaggcacttaatttattcaaaaatggtaaagaagttttattattttaaagaacttcaattagcacttttattttaaagaacttcagttagacttttcaaaacaagtctataaggggtgactatttgactattccttttgaagttctatttctacagttttagtaaaaaccacaaggtgcagtggaagataaaatgtctttcctcaccaatagtgttgaattcactgggccatatgctattaggttggtgcaaaagtaatcgcagtttttgccattactttcaatggcaaaaactgtgattacttttgcaccaacctaatatctaacctattttgtttggttttatttttgtatagatttttaaaaattcaaataagaaaattatggctatatacaataaaaaagcaccatgtaataaatttacatatatgttatactatattctaggcactggcctactttacatttactgcctcttgtctcacaactctgtgaggtagatattattattcccattttacaaccaaagaaactgaagcacagagagttaaaacaaaagagagagagagagagagagaagcccagtctaactctaggcttatgctgccctggatcatctcagataacattccaattataacaatgctgaaatgtaattggtgagttgatctaataattcatgcaatgcctgcctcactgtgaagctttcactcattcaacctcttattaaatatattttgtgatatgaaaatacaactagtaaatatgtagtagcacatttacagcctctaaagttaatagtattgatcctgtcaatgttctgctctgttctgcttctctcatagtgtccataaatttattcccatttgttcccatttattcccagtgaaggttacttcactgtttttaaggcaccaggccttgatggacgttactgctttagactttaaaatcatcatcactctaataatcactgtagacttctttatatctaagtcctatttatttccattaaagtatactgcaacaaaaataacgtaccatctttatttaccatgtggcttagttaagatggtgatataactaccattgttatcagaaacactatctgaactagtaaaacactgtatcccatcaggaaataacttttgaaatcagattgcatgggtttgaaacccagctccactacatagaagcaagttacttaactgattggaacatcaggttctttatttatcaagtgggagcaatagtataattaggttgggtgcagtggctcaggcctgtaatactagcattttgggaagccgaggtgggcagattgcttgagctcaggagtttgagacaagcctgggcaacattgtgagactttgtcgctacaaaaaaaaaaaaaattacaaaaataagtcgggagtggtggcatgtgcctgtagtcccagctacttaggtggctgagtagaaggatgcttgagcccaggaggcggaggtggcagtgaatcaatatcttgccactgcactgcagcatgggtgacagagtgaccctgtctcaaaaaaaaaaaaaaaaaaaagaaaaagaaaagaaaaaaagtacaaatggttcataaggaatattgtaaggattatcttttctgttaacgccacaaaagaccaccagaataaactgatgaagaaggaaactgagtttatttcctgatcaccaccttagcagatgtcttagtagtcatagaaaggagaggccaaggtggatatttgtagacatagggaatctggacttaagtagtttaaggaaggtcttttaatgtattgtgtgaagtatgtaacataatagtttgggatgggtagacataataacgaagttctggaggttaattgataagcaaccagtttgtctagttaggcaatatataatagtcctatgaagcaggctgtttacccacgtgagcaacttaccctcctgagaatgaggctgtttgaacagtttattgtttgaatagatttatttcctagtagttcttgatgcatgaaatgaagttgtttatgacttttaagccttatcatagttctgataggtaatctgtgtggttgctggaagtctcagttctgaacaaatggcatgatccatataaaacacacagcacaatacctgctatataattagtatatccacaaatgttagccatttataactgcctcttgtgtatgatgtttcttaaatcagggcttgatagatgggagacctagcctaactctgacaagatgcaaaatttggtaaccagacagaacaatagagtggagaaagtggtcggggacggtcccagttgtgcttagtaggagggggtgcaagatggcagatagctcatggatggtcaggaggagggaagaagcagagatctaagcaagcaggcaaagtatgatcctctgggttcttccagctgaaaatattaaacagagattaaagtgagtaagctggaagatctaccagcaggccagataaatttaggattaggagctacacatgatttaaaagagctgaaagggaaagaggcaggacccttactccatactgctacattggacaaacaggtaaagcttccctcaagcctagatggtctagtcaccagatctattactgaaattttttgggaaatagtgaatatgaaataaaagtttgaccacagaaattaaagataaaatacaagatattagaactgtgtcaatgatcagagtcctactagcagcatagctgacccaaataattttagagatcttatctataatattctgtacagtgcttcatattataagaatattataataataaattacattcatatcattccattataatttcatatgttctcctccaaacttctgcaatgtagatatcggagcagttttactctaatttaggtgatgacaaaactgaagcttagagagtttagtcacatattttaaatggcagaatggggaggaaactacaggttttccagacacagatcttgttccaatatgtccaaatagtaattatgttactgaggtttgaggggaatgtgttacaattggatgacttgcaaactcattttcatatactctttccctttcccttctctgtcttttgctcatttttggttatagaaaaaatcaattgaagatatgaaaaaaatgttttttaaaaaggtatttctacacttctatttcatcttgtaataatgcagagatatgactggggagttgatctgataattcatacaatatgactcctcattgcaaacctttcatccattcaaccccttattaacaatatttttgtgacatgcagaatgctagattctggagaggcagagataaataaggtgaaccttccttctgttctacttttaaagaatcccctagtctattggatttgatagatttattgtgaaagagtataaaaaagtaaaagattaaggcatgtagaaggtacaaggccagggaagggggccgtatattctaatatgggattagggaaaagtagagaaattccttggcttcctgttcctattttgtccagcaccgctatctcccacctgagattcctacgacatatttccaatggaagccaagaagtatgggagcgttggaagtacatcctgcccaatgaccctctcaccccatccccaccaataatcagaagaaaacagaagaagcaaataattgatctgatagcaaatacaccaaagatgagtacggcatctccctggattttaaaataaagatgtttggagcagatgaataccaatctgattttttaaaaaattgaattacccaagtaattatgacatagaaacttacttttggaagatttaacacattgtaaatataaaccaacacacagaaacccatgcaaaatttagtgcttcattttacttcaggccccaagctgctcaattattatgaaacaatcactttttggttgcccaagttttgtttgcatggatgcatgggagaacgatgaaatttctctctctgaatatgaatgttaatgattgggaaacatagaaaccacacataattctgcaattctcatagctcttaaaatatatagaggacttgcattgcaagtctttattttaattagtgttattaatattcattgactgaggtagtaaaaggcaaccactggctcaatgagcagcagtccaacaagtcatgcaaactccagtgttgacagcctttgtttggagtcctgaatggattgtgtctatctaaatcactgtgtaatcatggatcctttgtgatttcacattctcatcttatagtcaatttttatttctctgatgtggcatgttgtgttcagtagcttatctgaaaacatcaatatggttttgaaaggataaaatcaaattgtaacagtttatgtttctgtaatgtgtgcatagcctagggaaaaagtgataaataggaatactatttcactgtattgctatgttacagacattggaaatatgattctgcctccatattctttccaaagtagatcagctggatttattttttatatatttataaatcaacagctaatagaccatgagaacagcattagtgtacatccagatgacagaagagattgtaaaagaagtggagaagactttctgactttccctgctttcgtgacagtaaatattgtcttcttgcttttatatgacataaaggtaatcttcctacttttataagatataaacacacaaagagatgttaacctcatgcatcatattttaaaatgttggcataagcctaaaggttttacatgtttcaaagagtctatctttatggtaaagtacttgagtaaccattctcaactttggctacacatttgaacttccaaagagttttttaaaaatattttcacctgtagacacagtcagacactttaatcagaatttctgtgacagaagctctcacacctatagttttttgagctcatgagataattccaatgtccagccaagattaagagccacagatatattatcatagaattaaaaaaataaactttcacttccttgcaagtattacaaattcagcatgtcaatatagtgttaactgttgccatgataaagcttatgatttcactggaataccagatttcaggctcttgatttggacatcaaatattcctttcaaattgatgaaaattgctattgccatctgccacttttactctcaaagttaattacatatacattgtgctctacaataatgtcaattttgctaatcccatttagatgtttacataaaagaaaacaaataataacttcataagacatgttgctaaaagggttatttggtctaaatatacataatttcaattcaagctgacattttatgcttagttttaatgaagtgatcccagggaaattggtattttcctatctgatacaacgatatatatatttgaatgcaagattaaggcacattttaatatgctttatttgtttctaatttttccaattaatttttttacaattaatgtcatttaaaacttttgatatagcattataaaagaatctcaggcagaaatcattagtattactaaattatttttattgcattattattactactttaatatagtactgaaagaactatgcagcttgagacttgtattctgtgaaatgaaactttgaattagccaactttgaaagtcctttccagttccaccatgtggagattatgagctttactctgcagcatataccaaagaatgtctaccatacatttcagatgagacctttgagattgcctaccttaatcttattatgtaaaagatataaaaactgaggtgaaaagtggtgaaattatcctttttatatcacaaagaacaaattgtcttgtctcaagtagaatagattattagccaagttctatctatttgttttgttttaagtacttatccccacttccatcatttgttccttgttcatgttgttgttcttgtttgttttgaattgtttctggaaataacagtgagttaaaaactctgccagctttatatatatatatatatatgtaatattatatataacatgttagatattatttataatatatagtataacatatagtataaaggtttttttacacaaaactttaaatgcattttgttgtctaaacaaaagaaattattgtattcacatgtgttaagatgtgcagttttttcattttatgtgtctgaaattagcatgagtttttcaaacatggtcacagctgttcatatagccattgcttcatctagattatgtgtactctttgtactgcatgtattgagtttaattgtcattcactattttttcaaaaatattacattattgttcaatattagaacaaaaagttattgtctgaagagaacaagatatgaaagaacagcaagaattaaattttatatgattaaacaaagatttgttattgggggcatcattacaatcctacatttgcctgttaatcaacagctgactgatttatatggcttttttcttatcatgtcagccaaggaccaggaatgttggcaccaccaaggatggtattataaatgtagaatcatgagttcataccagatctactgaatcagaatctgcattttaacaagatccgcacataattcatttgcaccttaaactttaaaaagcaggactttatagtaccaaggaagatatccacaagaggttgacactgttttagatttcttgagttatatgctaaatgtttgtccctcatatgataagcaatactatttaaaggcaaagaaagcttaaatacatggaagaaacttcaaatctacaggaaaatgatgtgactgattcataagtcgagcataacaatattgatagaaatctaagtccaaattcatttaaaagctttttctgtaagctctatttaagtattaaatggactctagtgataagaaagcattgtgctataatttgaccacatttttttctttcataatagtagataaaatcatatcttcccacagatggaacattaactttggtaaaatacagacaataataccagttcattgtaccacaaattcatcagaaataatgaaaatcataactcttgcttatataaatatatgcatttaagataactagataaactgacatagaaaagaactaatttgtgtcactttaatagtacagaaggagtcttctttgctgaatgactttattcagctttattgaggtatatttgacaactaaaagttatatatacttaaggtatacaacttgatgttttgatacacataaacattgtgaaatgatcaagttaacacgtctgccagctcacatctttatgatttttttgatgtggtgagaactcttaagatcaatttcttagtatattttaactacagtatacaatacagtattattaattatagtcaccatgctgtgcattagatctccagaagttattcatcccccataactgaaccattttaccctttgatgaatgactgtttacacaggaagaagaggaagaattaattaaaatattagccctatttaatttttatgctacattaaataatgacagtggaagttttctctaagtaaacatgatagctacattaacagtaaactaattcattataattttgacacataaaatgaatataaaggtaacatttgtgagtggatttttttaatcacaaagtaaagcttggtagaaatactttaagatgctgtatcgaaatatctgcttttagtttgacattttaaatcatttaattgttggcatttcgtgtaacatacaaaaaatgttgattgaaaaaatcttttttaaaaaatgatgctgagtagactttattcactgtagtccttgagtgaagccactggttgttggcttttggactgcttttagcctgtttttctagttgtacttctttgaggaggatgatgatctttaccttactcttggctttgcatgctcaaagtgattaggtttttttaatgaggcaggagaatggaaatttgaggaaaatggtagagagaaccctctctcatttaccaagatgactttctaagtttatttagtgatgagctacttggagatacaagtcaaatgatgaagttcatagaaatcttttgaatcttgccaccagaaagagatgacaataaatccaactacttttcccatgccttacatttttattttcttatatgcacagtatcttttgtattatagatgcttaataaatctttttcaaataaatgtatgctggaaaatgttgtaattgaggtaaatggacatttttagctggctatattgcagaagactttattgggtaggtgatcttttagacggttttaaaaaataatgaagatcttaactggcacacaatcaagtatctgttatatgccttcatcttccacattttattgtatttttttcactcccttgtgaaggaaactaatttcaacaatgctgtatgtgtcatgcattaacccattcataattagcaagaggtatctgattcagtttatattatggtactaattatctagctcttcagaatattttacataaaaaaataacctcaggtgaataaacttctgtttctgctccagaaaccttttgacattttttaataatctgtaatcacgttgacttaaaatgacatgacagaaatgcctgaatgttgacgagttgatgggagcaacaaacatctgcctgttaaatttgggatcaccacctacagcactacacatatcattgatccaagtgtaccttgattgattgcttgaaaagaaaaatctggacttatttggatttataagcaaagtcaaaaacatttttcaaaatgttaagttctaaaagtagtaataatgatggtgtagccccttactaatcagtgtgctctggggaccagcagcctctaaatcatctgggagcttttcggaaatgcagaaacttcaccctagacctagtgaattagaatctgcatttgaataaatctccaggtgatgctgaaatgggaaaagttgccttctccctctcacacggcgtgtgatggggctgtggcttgcttcttcagtgcccctctgctcaaatctctagggcagtatatggacggacgggcaggttgtggggctccgaccccacagcagtgtttagggccctagtgggagcgtgctaccgtgtgctcttttaattttgccatctataggcagcttgtgttaaccagctcaattagaccctctaccttgtcactaccttgtcacaaggacagaggactttctgtatccggggttcttggcttggtgtaccggaagagtcacatcacacttgggcttggagaatgagtgcaaggttttattgagtggaggtagctctcagcagatgggggaagccagaaaggagatggagtgggaaggttttcccctggagtccagcacctcagcggcctgggctgtctcctctgactgccccagccaaattccgcctcctcccactggtcaatggcttgctggcttgccggtgcctgctggtgcatccctctccatgtctagccgtccgtgccttcctccgctgacttgctcctctccacacccagctgtctgtttcatccagctgtctgtgtcttctcgggcagatctgctcttctggacgtccagcagcttgtgtgtctgccttctagagtctgggggtggtggagcgggggtggttataggcacaggatggcaggccagggcggtcttgggaaatccaacatttgggcaggaaatgcctgtcctcacccagggtctgtaggggtggagccctagccagggaccacgccctcttctacccagcacttcccttcccttcttccctgtcatttaaagggaccacgctcttaccttcccagcacttccatatcagtgactgtgcacattacagtttgagaaatgctggtagtccattccctttcctgatctccaaaacatagggaaattttagaggccaggatgcatttagtagattctgaatctaaaggaaacctaaatcattccttggaagtagacattgtttatagcatcctcaaatggaattaaaagcatatatgactagatttagaacagaaaaatctgttttacatatttcaaaaccctttggacccttgtctgtttatgttcctatgacttcttgagttatacatttttattaacaaatgataaaattatattcactaaatgaactcatttgtacctgttttaccagtttcagaatgttattttatatttcttaggtttttcttagacttgtagaaatcatgctgctttgttccctgcaggagttaaaataaaaatattagtaattatgcatatttaattttcagaatgccaactgattactcacagcagttataaaagggaaatgattttagatattcataaaacatttccttagtaaggggctttcaagtctgaagttgtgttattatggatatttctttttaaaataatcaggataaaaaatgcatttattaagatccctcttcttttctctttttcagatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagaggtacaaactggttttttgtttttgtttttgtttttttgttttgttttgttttgtttttttgtattagaaagctttattatggccaaaaagataactaggcaatgatctatatttgcattataattttactagccctgccacagcctatcagattctcatcaagaacctcattaatgccaactctagaagcaaataactaattctttcactttctctcatgattctatatggttcttacctaaaatttcagccaaaatgactttcaaaaatatatcttttttccaactcaattgattatattattgagcattctcatatgattttatggatacttgacattaattaactaatgaaatctctattattttatatctaaggcagtaaatactgataggaattggccaccatttctgtgtgttgaatttccatcttggtagtatctctgctatttcttaaaacagtttcaaaaatttttcttataaattcttatacatgttacagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggtaagaatttatgtgttctgtctgcctgggttatgactgaacctcttaggacagttccagatgtccatcagaatttctcttccaagttgctatttttagaaggtttattttatagcttttcttaaaagcacgttttcccacttgcttgataaataagactgctgtattcatgctggacatagatagttgattaagaaatagtgaaataattcaaataataaaaacgtgttaaattactttttaggtgaaggaaataaatataatctaaaatagtataattgtgttataaagcacattttcaaagcacctttttgtgttctgacaaccaccctgtgaggtaggtactgtagatattcttatctataacttataatgaggaggaacaaagaagccacatctaacttgctcctgtcattggaagtgctgggaacaacaattcagctctttccagttctctgccagtgttctgtaaactacacgagcacccttagtcagtctagttcaaatccacctggaatgtcttaaaaatgcacacacacacatgcacacacacagcactgaaaaaattataattaaaaaaagaaacataagagcacagctataagaatatgtttaattatttcaacaatgtcaccttatacatacacattttgaaatctggaaaattgaataaataacacttatagaaattaagaatccttatacatacctgcaattccttctgttgttgatgaagtacaagcattttttagcaaatatttataaacactggtgataagagagtataatttctaaatacctagataactaacattgaatgccaactgatacaataacaaaacattacataacaccatacttgcatagtcatttcgtctatagtagaaaattccttctagaattgacatttttaattagacactcaagataggagctacttagtctgagctagtccagccacatcacttaaacagcaggatttggtacttgccaggaagatggatggaagctgtcagtaaaatgaagcacagcagttgaagaaagcagtaggaaccttttagtccatagagtgttgtacatggctaataacatttttccactctgtgtattgtacagtacccacaggacaatcagactggcaaagtaaaatgaacttaaaaatgaatttcctggcaaattttggtacattatgttgttttttttttccacatgtgtttcatattcaactgaatgagcttttaatgtttcaatacggtcatacataggctatttatttttttgatctaacaacataattgcactgtatttgcatatgatgaaccctattgtcttgacctgattataaagtttaaaactaccctaaatagacagtctgttcaagatttttagacctaatttcttctcctcacaagttaaatcattaaatctaataaaggaagtgagaaaaatgttgatttttctggggtccagagtcaccaagaaggttttccaaggctagaggagtcttgttgatcgcagataagttgaggctctggtcagttgtgtggaatataagacttcaattgaaaatgagtattggtgaaactggtgttacaaaacaagtatgaataatggacatttatgtgcttttcatatctagggatgattcagaagcttatttgtgtatttaccttctaccaaatatgaaaaaccaactctggtcttcagaattagctacaaccaatacaatttgagtaggcctgaacatttacttgtggaaatcacagaaggttggtcccataataaaataaatgaacaggcattagatcaagaattagagaaggcacaacatggattaaaagtgtacctaatgattttcccaaatgaaattttctaccatagaaagctaccattaagaacaccaacctttctcttactttaagaaaaatgggataggccaggtgcggtggctcacacctataatcccagcatttgggaggccaaggcaggtggatcacctgaggtcaggagttcgagaccaacctagccaacatggtgaaactctgtctctgctaaaaatacaaaaattagccaggtatgatggcaggcacgttgggaggctgaggcaggagaattgcttgaacctgggaggcagagtttgcactgatctgagatctccccactgcactccagcctgggtgacagggcaaggctctgtcaaaataaataaataaataaataaataaataaataaataaataaaacaccagagattaaagttgcttatctttccctatcttaagctatcatctagattatacatgtaaactcttaatttgaggacattttactcagaaatggtcatgaccctatcatctttcatcggaaacatttacttatactgacggattatgatttttgttgttgctgtttgttgatttctgtttgtttttcctagtaggtgttttctccatgaagatgttctcagaactctctaaactaacgtaccctacttgaaatgcaaactaccagatctaatttgccatcatcccttcttacctccctgaatgctatttcttttcaatggattatagctaaaatgatgcataatctcaaagcagctctactaatcatgctgtgggtggaggttttataaaaaatagaccctgctcatcttgctaagttagtacttagaatgcatttggaaataaacttgtttagatttcaaaagatagcataaagtaaactgtaaggaatatgtagtcaaaggaaataattccatggactaataggataaaatgaagctaaaggcatattaaagtaacaaaataattaaatttcctcatatcagctataatcagtttgaagaagataatgtaacattttaattatcatgtgtctataaattggttttaatttctctgcaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggtatgtagatcatatctcttgaagattatgtatatccccctaaaaattaaggaatattatagatttctgttctaatgtttaattatttaattgtatccttattattcaatatacatatacattatgacctttacataatcatataaggatcaatgacaatattaaatctaatttaaattagtataggcaaacttaagtattggcaaaaatgctaaatatcttttgaaagtttatgtattcttgtattcaaaatatatttactgtgaattttctatgtgacagaaatgtgctagccttgacacttcaagtaaatgtgtgtcttaccttaaagtatagatttataatagaaatgttctcaaaactgaaatagccaaaaatgttttggtaagtattctaaatataccacctttaaaaggttatcttccttatagattctataggtccatttggaaaatattaatgtattcaaaattatgaagggcttattatcccaaattacttcaaatactacttaagttgaaatcctgattagtaaaatatgcacttacttgtaataaaaaatatcatatacatctcgaattgtctgtataagcattacccactttattaacacaaaagtatcatcttcctacttaaacacattgtggacctcttacctgaaactaaaaatcgatttcctgaaaaatactttcggaagtattcactagtttagttctttaaagatgaatttggcaaatcatccttcctttggaacatgagagaaataccctaacattctagaaacatacactttaagtcctcacttagcattgtcaacaggttcttggaaactgcaactttaaacaaaataacaaaaacactgtcatcaatcttataatggaaggacattgaactaaaggatgttactcgaggaccttttgtttgtcatttcacttaaagttgcaacaacattaagtgaagacttactgtatgtaaaatccatgatctgaacaagaatgtctggtaacctactgaagggatgacttatctattgtcacctacttaattatataaagaattaattaaaattaaactctaaaaataggctaatggaagagaatggctaaaggtatttgttactgaacaattaaatattagggatgttaacttctaaagaagatctgttacatcaaagagaaaaataaaatgtgacttctaacatttgtataaagtcatgtaagttatcctgtcagtatttaaaatgtaacttagtagtcttaagtcttgtataatcttcaaattcaccaagtcttattgatacttacctttaacaaactgggaaaatatagtggctcatgttaccatcatttattagatattctattttcccaaattgttttcatttagtgttagctgatttttaaactttagattccgagtgaaaactatcagaatgcttgaccaatacacttacatatagataatgtttttattcatttgaaaatgctgtttataagaaggcatgtttatactcatttaaaaaaacacattggcaaaaaacatgctttatttatgttctcacagagtcaaacggaagataactaagaggtagccagcattcacagtaagaaattactgatctcattcataaaataaagatctatgtagaaatcaatcattattactcatctttcattaactaaaccaaaagatgaatcatctaacttcctatattttaaccataatttatgtggttgtattgcagtaatatgagatctgataaaatctcagtatattttgtttcctgcagtaacggcacatcattttattttctaacatgctgaggaagctgaagtgagagaaacagagaaacctcagtctttgctgaagtttctagatttttgtggcaaaaggttaattaattcatgggttcggttgtaacagcctgcaggtaattttcatcagcatagctgtaatgtgaacgttccttctacttgtaatctattgcttgaagatgtgatcatttttctcacattcatacaaatagataaatcattctagatgttgaagacaatttttttcctacttgattaacagaattctgaatagctaaagtgatgaaaatgaagctgaaattttagttttcttagtggaatgcttcatttaaaatgtcagttatgatagaactttgtagtcaccataattggctagtcatcatttagaaatacaatcatgcatctgcttacattgaaagccaagttgaacttgtgacctaaatcagttatactacatctaaagtaaagcttaacatggtcattcttatttttctgggctttggtattttcattttcataataaatggagtttgtgaaatacttgttaattttcatattataactatggaataatatacataattacgaatatatattttcctttaatcagtaatatatagtttcctttaatcagtaaactttccttgacatttaataatcaaattatatgacttttcaagaatatttcaattatatgtgcaacaaatagtactttttaaactggaggtcataaactaggaggttttgtgccaaatattctctgtagaagtgttttatttggcatacatagtgttttacattttcaaaaattaccaacactttaaaaatgagatattttaaataaaaatctggatttccatctactaataagtcagaagatcttgctacaatggaccaggattcttacctggcaccatcaggtggaatttaatagaaactgcccatgtagaaatggcatgaaaacttttcccaatctccacaactccttctaaattatgttcctgacactgaggctgagggtcatttgacatttgtcaatattcttgaaattgaagaaatatttctctgcacctgtgtcttgaggaaagggggaaaatatatttattgtaacaaatccactttatataattatctttatctggctataatcttttaaagttttgaccctggtcttagaggctactgcctgggaaatggctgagtttgaaactcatcaagcatatcacccctgtataactatgcatatacattacctaatagagtaggcaactagtagcaaagttacctgataatgcaaataatactctagatcatttaattaatttggggatgagttatgcattttttcctaacacatacaaatgggaggtgatttggtttaggctattgaaataagtttgattccatacaaaaacaaacatacaaactgttctatttgtattccatgcatacaaactattgggcgctgtgctaagttctgcacatacaagcatggataaggctacctatgctgtaaagttgctcactgtctggcactggccacaggtatgctcgatgagggaaagagtctagtgtaaatggtccaagtgtggatgtacaggaataattatgtctactactaaagtggtgtggacctctagaaaggagcctggcttaagtcttattgattgctttagtctcttaattatgccctgtaagtgaacctcaataaataattatgaagatattcatttccactttaatttcacactgattaaaatagattttttaaatgaaaaacctactggtaatttccaagtgaatttaacttttttcacccttcacatcttaccttatggactcttttacctttaatcatcattaatatttttaatatgactgccttcatttttacttcaagtgccatgttgagtatatttctaaagtaaaacaaaagagttttagatgttcttttaattctgatatagtaataaatcaaacataaatgttattggtttttatttcagacctattttacctaattttatattcctttttattgacattcagttgatttcatgcatttatttttcactcaattagaattaggagtttatgaagatcaaataaatcaaataacatcattagtatctctgattataattgtattttattgtgaaaaactcatagaatgttcacatatattatctcctctatcattctagtgtgatcatagaagaagcattgaaactagccttggaggatctagttttatttcaagctcctccaattgagaaattacctagtcttctcaactataaaatggaaaattattctccctgctttgcttaactcatgaagtgctataaaatattgaaatgagcaatgtctttgatatgaattaggttttaaatttatatctgataatgtaacatataaatattgcaaaataaatgtgacaagtacccaaaaggatgaagaagcagaacaccaatgagccatctcttttagaatttggttgtattttcttctaaggcttttctattcaatttctctacaatgtaaatttgatatatcatcaatatttttctatgccattatttttccccacataggttttaatggctgctaatgtctcaattacttacgatgtttctctattttttttgttgactaaagttcatcaagagtttgtttgcacttcaatttttttatcaattatttcttcacctagtgtttgcatacaaagtgattgctttagaattatgcatttgaatatgaaatttgttttaatattcctgacaccttctgccaatttaattcctccccaaaaatattatcactgaatcaatttataatttcactaagtataataaattaaaaacacaaatgttactctttaacatcttatacaaatataagacaaagtttcttatatttagtagtaacaaataatttacttcttaatttttatcagattgtattagacttttctcaatccaaccataatatacgtttggattgcaggaaagaaacagaaatagatatcaccaaagcctttaaaacacttctataaaataaaagatatgaaaacaacagcacagggaaaggtcaacgttgtgagcagaacaaagactgaaagaaataactaactttggaatgctcaactagtcaatgctcttgcttactcctgttaaaatctaatgtatgttgattgagagaagtaaaaaattatctcctcagataaaaatatttgaatctatattctatgaaagaaagagtacttttatattatattactttctaatagtttaggggataatttgggagactttcttagcagcctgttgggatgagaagaaaactagggtaatagagtgctaagttaaatattacatttatatactgaataattttgtcacatgaaccaaaatattttatgacatctgatcccagctggccccattgtttattttgatccctcgtaagcatgaaatgaaagtacaatgaaagattaaaatttgcaccaattactctacatccttgtggaagcttagggttttatcaggtcctaggaattattaaaaaggatttagggaaaaaaataactactcctttattggaaatatagatgtttaagcacaagtttaagtatttgattctcatgcttattggtaagtgggttctttggcagcaaaacaaatcatttgcccatactaagcagaacattatatttttcttattccttaaaaatgacacaaattgtttgtgtttcatcgactctgcaggattttagtaagcttccatgtctagagcctaagccagcataaagtcttaaagtaacaatttcttctctacagaaagccacatcttcatacccaaacacaggttcagatgattgtaatagtgtgcggtatccaccaaacttcccatttttatcagtaaaaactttaattacattcagcatttaattattcatcactctgatagaaaagcatttgtgcctctgcttcctttctctttcctctgctttctattttggttatagtgcatagaataaggaagaaaggagagaaactcatagcatttcatttcctttgggttcctaaacctacaaaatgattaacctaataaagccattagattttataatttaaaaaaatcagacgtgaagatttcagctattcatgctcatatttgtaaatgtaaaaaaaaccttatttttattacttatctttattaattttataatctatggaaaatgtaattaacacagatctaaatactaacagtgtagatattgtgttatttgaacattataaataatagcttagaactaagctgtggtctctgaaacattcttaggagtttttcctccaaggcccttgattatttgccaagtaagattaaatagaatcctgatgtatccaaagaaaaaaatagaaggaatgatgtttccagaactttgagagaaattgtttatgaagggcagtccaaaaattcacaggaaaacatggtacataaacatggagcttgaaatcaggaaacatgtactattttaatttattttattttattattattatttttttttttttgagatggagtctcgctctgtcacccaggctggagttacagtggcgccatcttggcctaccgcaagctccgcctcccggattcacgccattcccctgcctcagcctcccaagtagctgggactacaggtgcccgccaccatgcccggctaattttttgtatttttaatagagactgggtttcaccgtgttagccaggatggtctcgttctcctgacctcgtgatccgcctgcctcagcctcccaaagtgctgggattacaggcgtgagccaccactccccgctaggaaaaatgtatttctaattaactaccccaaatcttttgctgtataaggtatatggacgaatggaaaaagatagatagatagatagatagatagatagatagatagatagatagatagatagataatagataaggaaaggagaggagagaagaggagaggagaggaaaggaagaaagaaagaaagatgacttttttatccatgctaccaactagttaggggtccttgaacaagggacttaaacacattgcaactaaattttttgaccaaaactgtagggattttagagctctgaaatattacatatctgaaaattaattggacccagaaaacaataaaaatgaagcaacttataatcttggtaaacagagatgtttctccttttttgatagataatatctaaaatgtatactataagctttgtgctggtattgtttcaagactgttacatgtattaactcacatgatccacattttataggtgatgaaactgaggcacagagtttaagtgactcaatgacagtcaaacactgtggggctggggtttgaatccaatctagctatgaagtccagacttctaacaactaaatttggctgcctcttggggtctcattacctctatacagggtgattatcacagcgtgaaatacaggatatattgtcttcttggtgaaaatacagacattacattttagcattactgaataattaaatgtattctgtcacaatttctgttgatttaccaacttctggtgaaaaactccagcatttttccatgtcaaatgcatacttttttgagacttttactattttacatagttacaaagcttcatatcttaaattctaaaatactatcacaaactaggcactgtagcatgcacctgtcatcctgagacaggaagatagctggaggccaagagttcgagattatcctgggcagtatagtgagacccagtctcaaagtataactaaccaaataaataaataaaatactatcaaactcaacccctaaaactcctattagatgatagagcctttgaaaatcttgcaattagtgaaatcatctttgttactcatcaatttagcaggtgcgagcaaagaacatttttggaatttcagaaataaaattgcagataattttaactttcaaatagattgttctgtggctatagagatacattactcatttgtttgttattcagtaaatatccattaatagtctaatactattaaaccaatgtattgggtatgcttatagaagtggtgaaaagtacacaaataaatataatactatatacaataagaattggccagttccttgagatacacagtgataagggcttatagaagaaggtggaaggggaagagtatgtcttgattgagggagcagggggacggggcagtggtgttgaaggcaggctgcctagagtgtataacatttgtattagactaagaataatcaaatttgaacatataaggggagttttcaaagaaaaatccaggtgaccaatggatgtgaacaaatataccaaggcacaaaaatgtaaagcatttaccagtaacagctaaacactttacatgcagggaaatagttaaagggggttgagaggagctcgttgggtagccccattgtttattttgatccctcgtaatcaaatggctagattactgatgccaggataagaagctagatttatttccttaacatagatttttgaacatctattaacatttttagaggatcatcaatttagagaaattaatctggctatggtttttaggataaatttcagaagcagaagaatctagaggcatccagatcctctcagcatctaggcatcttagcatctaagaggaccccattattagcaaacatagaagactaaaagtatcactatgataacagagatgagtcaaaaatacttcagaaaaaaaaagaagtattttggaaataattgaattaggcataaaaaatgtggtttttcattttatattaagagactggaaagaaatataagacattaaaagagagacagataagtagcaaattttcaggtctatgatgtacacactgaacagagtcaaaggagttttttggaggaatcatctagtgagtaactgcaaaagcacaacttatgcagaggaaacaagtatggaaacacagattaggagtgaaccataaaggtgacagtgaaaggtatgtgatgaatgatctgatcttacccacacaaagagcatagaaagagaaaagtgcccctgagagacccttgggaggactaatttcagatgagagaagaaattattaaatgcatatatccacaaaataatattataatggtatattgcacccacgtgatagatatgaaactaagagcttgtccaaagtctgacagcaaggaaaaaggaggggaaggggatgtcaataagaatcataaaattaacaatcagattagtagaagggaaacctctacagaacaatgcaataggagctagaaacaaaaatgatttcaagcaggaagcctgatgtattgtgctatatactttcagaggaaaaagttaaggacaggttattggagttcaaaatcaatggggacctttcagaaagaagttattgtagaggcgggagcaggatctagcttctagttgaaggttaaaagttgctaagggggtatgtagaaagcatcctttcaagaaggttaccagggaagggaatagaaaatatatgtgtctggtttaacagagtagtaaggtggaatgaaaatgttttttggtttaggatagaacttaattcagcaggcttgtaagctcaagggaacaatctagaaatccaaggcataaaacataaatgttaatagtcgatgagcaagggcctgaaagagtagttaggagtctgttgaggccacaagcatgaatgctagaccacaatgagaggaaaggagctattcttttttatgagacaagaggagagaggaggccatgaggaagacacatttttaaacatgttgagctagagattgaaggagtttagatttcatgattgagataatttagatttcatgcatttccttgatccccagatggttgagaagagtccaaaacttttggaaagactcaggccaggtgtggtgactaacacctgtaatcccagcacgttgagaggccaaggtgggcaggtcatttgagcccaggagttcaagatcagcctgagcaacatagcaaaactctgtctctacaaaaaatacaaaaagatagctcggtatggtggtgcatgcccgtagtcccagctattctggaggctgaggtgggagaatcatctgagcctgggaagtcgaggctgcagggaaatctgattgcaccactacaccactctagcctgggtgtcagagtgagaccctgtctcaaaaaaagaaaaaaaaaactcagttaaaaataaggtaaacaaatagagagcaggattgttagcagtttgtgaattaagcagagaatcaataatgtggacttgtcctataaccagttaaccacatcttattactttcccagtgtcttaatagcagaagtaaatgaagtgaaaggtagattcacccaagcaccaaaatttaaaaaaaaaagcgagagagataattggaaattgcagaaaagcaagcacagagaaccaaagttcctaagctagtgttttgctgacatggcagagccttggaaatggattggaagaagggaagaagaaattcctgaaagttgttattaatgtgagactatggattaactaaggaaccataatcaccaataaaggataaaatgacttcttatgaaaataggaggggttaaagagtaagaagttatgctctgaggcaaatttcagtcagcatcttggatatgaggtagttctaaatggttttgaaacctaaagtgagggtatatagagagagaggagcccaaattaaatgaaggatagcaaggattttacttaaatgattaacatcaataacaacaacaacaaagataaattacctacccttattaactgttggttatgtattgagaactgtgttaagtgctttacttctgttaactcagttcatctttcctacttactatgtgtggtaggtagtgttcacagtcattgagctgactattcccctctcgttcaattgactgtttggttgcttggtttgacattgtttagacacaaccttgaaaagcaaataatttcagttaatttaaccataatcaagatttttcattttctagatgctctgaacacttaaggtgcacatgggcatatgtaaatattttattaggcatattacagggcagttaacttagaacagaacgtgttgcataacattggctatggctataggtattaaacattataaggcagagtctccaatctgagagagctaactgatattgcaaacacaaaaaaaactatccaggagtatctgtcttcagaaaatacaggagtttcttgaagaattgtaattttattttattatttttattattttcaagcataagtaaaagttatttgagtctttcttaatagtataaatagccacttatacatttctcacatagaagaatgatgaccaactgtaagccgaaattcaatacatgttatttaaattaaaatgtgccagtactttatcagtaagtagataagtagatgggcactctgaactgattattaaaaatgcatcacttaacaatattaagcatttggttacattatgataggataattgcagcaattttggttcctaattttatcaatcaaatagactctccagcactgtaatatgttatatagttattgccatagtgttccaaaacccacatcaggtgagggtcatggctacttcctaattaccatctgtttagctttgttagtgtttctcattataactcagaaggtcaatgatactgttcatgataggaacccagcaaggcgaaaagtaataaaatagctctgagactaagcaaggctctgctactccaactgatggacagttaattacctgagcataaaacagtgagagcactgggagaaatagagaactttgcaatatggtagatgtccaagtacaatattatttggtggtttttcaatgaacaattctgtttaattaaaacatgagcataacctttgtcagaggagaatgtaattttgacaaaagcaaaacatttggtttttaacagcctcacagactacttagatgagcattccaaatctaagtttctatagcagtttctcacccttggcagtacattagaagtacatagaaactttatataataccaaagtcgggccccaccccaagccaattaaatctaaatctgtggagggtggaaattaaacatgcccatctttttttttaaaggtggctcagatactgcttttgtgctttgaaggttacaaaccactatattacaactaacattcaaaagtcatcattgccattatggatctatttgtgaacaactacaatcttctttttaacctttaatttgcactgcttttatatggaaagacttgtgtagctcactcattaaccattgtctttaatttgtcttttaaattatcaactaattaatcttttaaaaacttcacatctgacttctcagctcccatggaggaattttgaacgtgaaaccaaaaggcatttattcctagaaaaaagttttagaatcccttcgaagtgtcctttcaaacctctgaataacagaaatcccataaatcctatgggatatatgtttttccatagaattagatgattaattctatcattttaattagtaaagagaagaataaacaattagatgtaaagcccttatgttaaaaaaaatacctttgtaactatcgctagatacttattttctataaacattttatagaatttaattttttttatttttaaataggctatggatcttttcatagtgaaaccatgtccacagatttctagagtttacataaaaatgatttacattatgtgacctaagttgacacctgatagtttcatgaccagctaaccacttcaaggacagtgcaaagggcagaaacctctcttcgctatgattttcagagggaatatagaagtaccagtcttccatggccagtgtcactttcatctatctatttgatcacctgtaaaaaaaaaaaacaaaaactaatatgagttttaaagaaaatgtgaaaaaaatgctatttcttaattttaaaacttcttacaccttgactttgtgtttttagtttgagattttttaaatatttagaatgtctcaaaaatacgtgctacagtctcattaaactccatacattgttttcaaaagatattcttttctttttgttttttttcaactaggacccctactatggctggtggcctattttctattgacagaaactactttgaagagataggaacttacgatgcaggaatggatatctggggtggagagaatcttgaaatgtcttttagggtaattgcattttattttattttttgatgctgaacatacaatgctgtagcatgcacataccagtcccagtaatttactgtcaaatcatttttgctgagtgatgcaaattactgatcaattggttatcttaattcacattttgatttgacagagtcctattgcatgcaatattttcttctaaatgggaaattataggtaatttttgttttcaaaaatattgtttttattcacagtaaaaatacattaggactttcaattgctgaaataaagaagggttttattttttaataacgtgttgctctataaaatcactttgtgtttttgaactgaaacttggaagtatttatgtaatctgaatttgcaactactgcctcaggttgttctcagaaaactttaagaatgaactgtggtcaaatgaatttggataattctgcaagtagtgtgaccattttcactaacattattgttggataagtcagtttgaataaagcaacttcatttaataaatggccttccatgtaaataaaaattgaggaataagtccttacgaatatgttattaggaaagtttaataataatttaaataatattttgttatattcaaaaaatttaaaaatgaacacataagttttctttcatgctaagaaattgataagcactaacatagtggttttgtttttcaaatcactgcttttttttctacctaaaattcagtgtaaactatttgtgagtgttttttgttattgttgttgttgttttttgagacagaatttccatcacccaggctggagtggtacagtggtgcaatttcagggctcactgcagcctagacctccagggctcgggtgatcctcccacctcagcctcccttgtggctgggactagaggtgtgcaacactactcctagctatttgtttttctattttttgtagagacagggttttgccatgttgcccagggtggtctcaaattcctgagctcaagcaatccacccccctctgcctcccaaagagttgcgattacaggcatgagccaccacacccagcttcagtgtaaaatatatgaaacattccatcttcgcccaaaatatttgtacaataaaattattagagtttagatgtatttatctatgaagtttaaaaattatgccttttaatttctcatttcaaaagtaaagtttgtttttcattatcataatataaatacgtgtgatgttgtgtaagaaaatgttaaaatttgagaatgagttaccttgaatttctctactgtagaattcagtggatcttggataaattattttaaaatcagtaggatggcctagttatattactattttgcctgtaaactttcctgatagccagatgtctgagacaaaccttagttaatggaattttattatttttgcatttgtctatatgcttatattctcatgaaacttgccaaaccaaactcagcaccacactcaggaatatcttcttgccttcaggtccatggacagtaactctttgcaggaattttgaggacatttgagaacccaaaattattacctgttatggttcttatggtgaaagaaataagaggtaacagaaaaagaaaagaaatcagtatattcagaagtttagaaataatttgcttctattcttagaagtaataatgagagaatgtactcattcattaactgatattcttcgggtgctatgctgggttacgtaagaaataaaatcaacacagaaataccgctactatataggatcctcttgctactttttctcttgtcttcctaaaattagaattcacctctttcctccctacctgttaagcttgattttctgccaatgtactcctcttacttttatcacatatctcccagattggcgggatgctctttatctaactggttgaaagtagaattcagaaagaatttagtggaataatatgataaacaaggaggacctgatcaggaaatgtaacagaggtataaatgtataaaaaggaagacttgaggatatgatagatgatgcagataccaagggtacagaaggaatgcagctaggggctgtaagaataatcaaatccctcaaaaatgacacaggaggttttctgtgattggttattgggattattaggaaataaaatacttatcagtgactattttaaaacaatatcaagtgttttaaaatgtattattatctttagtttccatatgactttaatagaaacaaaatatgtattttgctttttattagactcttaatttatgttttactttcttctctgtgacatgaatatgtttgcttaatggtttgtactgtagctgaggtagacattgataaggaaaaatgctagaatagtgcattgacaaaagattgagaccactcatctctctttaatttcatgacttgatgaaatgagaatatgttgagcatttataatcagagggtttgaatctaatatccagctcaatcattacacaacaaacatacattgagcaagtgatatgtttccaggtgctgactttacaaagatgagtaaagcatgatgcttctttgctctcaaagaactgcattcctatgacagagatgcgtaggtgttattgtcaagaaaatgtgataatttcctttataaatttatgtgtgaggttttttgtctctgtcatgtgagtataggtgaacataaactcaactgtaaaaaggtgattataataatagtgaagttattgtggttttgtagctgtggtctacataggttctagtctaagtaaagaagatagaaatatttagggcttgcaaaatgttaagattctgactcacctcaaggtattttaagccaaaccaaaggaatacattgcaaagacttatttgtaacatatcacttgatcgctgtacttaaagacatttgaaaattttatgaaagctgtagacttcctaaggaagatgtttccaaccttttaaagacaacagatttaaatacggtttcaaagtgtttaaaaatctcttgaaaccttaggagaaagatccttggcatataataatagtgactattagtatttatagtagctagtaagtggaatagctaagagttgacccgcagcattctgacaccagggactgtgctgttaaataccatactgttacctcctcattaaggttcatctctccataacataacgaacctaacagttgatggtattattaggagaaagaaagacgctaacatgcaaatacaagcttcctccacaattctgagatgcttctctcgtctataatcttatcttcctcttataggctatagcctctaatggaagataatacacattcaatagcagtgagaatatcaggtatatctaccagagaacagcagttaggtcttaatgcttctgaaagctgtttcaaatatttctccctactgcattacacaacaatcactgcaataacataaatcctaacagcactgtctaaacataagcattaattaattatgtttagacagtgttatgtatctgctggggatacagtaatgaacagaacagacaaaactttgtgctcttatggaacttagattttggagaaagagacagacaataaacaaaataaataaaatttattaaaatatcagttataggtgttaaagaaaaaatataaggaaggaaagattctatgaagtgttggattttggaggatacataggggttgaaattttagacaagaactgagaaattgatacccaaataaaatagtgataaaatgaaccaagaaaattatgaattaccatcaaaaagtatcctctatctttaaataataaccgtgtttcaggataagtatcaaccaacaagcatcaccaccaaaagtccttgtcttttataagcaatatcatggggagcagcattcccaagagtacagatcattttgcccattctaaaatgaagaaaactgccactatccaatcaactcagagcatgggaaaaaataaataaaggagcttgatgacagcaaaggacacagaaatctgtctcacagccatgaatggttacaagtatggactgggattcagatagcctgcattcaacacccagctctggcacttaccatctgtgtaagcttaggtaagatagcacatattctaagctttagtgtgtccatctctaaaacagaaagataacagtactttcctcatttttagagaaagattaaatgatattatgtatattgtgctgagtactccactcagcacatagtgtgtcattcatggcagctgttgtggtgattgttataagctgtgcaactctgggcaagtcataacattcctgagaatcacctaaaaacaatcttacctttaataatttggctttgatcatggttaatcacaagagagaatgtagagaaaaagtcatttaaacccagaaatgcaatatacattaaagtataattatactaagtgttagttgagatgtagttctaaggctcccctgctcaaaaaatatattaaattttaaaaaggaaaagaaaaaccacacacaaaaaaatactttttatacttccacaacatcattggagttaattactgacatctaagaatctagggtggaaaacatttttctacactcataaatcagttggaatgaaacagttgttaatttttaaaagtatgtatcatctagacttggagtaacaagtactagatttaccattctcctcgtcattcacctgaataaattaaaaaatggacaaaaatacatgaaataacactttcaagacattgaacagcagtcaccctgagagatgggaaacaaacaaggaaagccttacaattgcctcggcttactgccttgtgaaagtttctaggccttagtgataaaagggctagatactgacagactccatgacttgaggagatgaagctgagtgtttggggagaccaagcccgctggaatttggtgaacagagtaatggagtcctgggcagagcattgaagagatatacagaggtttctgtgggagtattcagctgtgtcttcacaagtgtgtgaggaaacaatccaagtctgaggaaagaaccttcagaaaaggttagaggtctcattgcccagtgatgactcaggaaagtcaatagtacctgtatcctccagacagattgattcatgaggtaaggggtagaggaaatattgagaaactacataacatacttcttaaaaacccatggatagtctggatgtggtggctcatgcctgtaatcccagcactttgagagatcgagcaggcagatcacctgaggttaggagttcaagaccagcctagccaacatggtgaaactctgtccttactaaaaatacaaaaaaaaaaaaaaaaaaaaattagctgggcatggtggtggactcctgtaatcccagcaactcgagaggctgaggtagaagaatcgcttgaacccaggaggcagaggttgcagtgagccgagatcatgacactgcactcccgtctggacaacagagcgagactctgtcaaaaacaaacaaacaaacaaaacccacagattaaagaacaagtaaaattaccactatttggaatgtaatgaaaatgaaaacatagcacatcaaaatgtgtagtgacactaaagcaaacttaggaattatttatagcactaaatgtctatatcagaaaagaaaaaaaaaaaaaagaggtaaaatcaatgaccttagcttccaccttcagaaactagaaaaagaagagtttttatgccaaagtatctaagaaaaaggaaataataaagataacagcagaaataaatgaaatataaaaggaatatatataatattccacatatatgatacctatatgataaaaaaaaatatatatatatggaaaagcaatgaaaccaaaatttgtttccttgagatcaataaaatagatgatattttagccaaatatgggaaaaatagagagatgacacaaattatcaattttggaaatcagaaaggtggcatgaccaccatgtattctacagatggctaaaaggattggaatggaacattatcattctcattatgccaataaacttgacaacttagataaaatggacaacttcattaaaagatacaaattatcaaagctcacagaaagaaaaaatagaccaaacagccctgtatctagtaaataaatgaaatttattctaaaaatttataatttttaatactttaaaaataatttttacaaaggaaactcaatggccagataacctaactggtgaactctaccaaatgttttgggtagaaatcagaagagttcgggccaggctcagtggctcatgcctgtaatcccaacactttgtgaggccgaggagggcagatcacctgaggtcaggagttggagaacagcctagccaacatgatgaaaccctgtctctactaaaaatacaaaaattaaccgggtgtggtggcgggcacctgtaatcccagctacttgggaggctgaaacaggagaatcgcttgaacccaagagggagaggttgcagtgagccaagactgcaccattgcactccagcctgggcaagaagagcaaaactctgtctcaaaacaaacaaacaaacaaatgcttccacaaaattgaaaggaggtagtacctcccaattcattctgtgagatcagcattacacagataccaaaacttgacaaagtcattacaaaaatagaaaactaaaaattaatattcctggtaaacattgatgcagaaattctaaataaaattagcaaatcaagtttctccgtatgtcaaataaataatatatctgattaagtagtgttcattgcagaaatgcaaggttggtttagcattcaaaaatccatcaaggtaattcaccgtatcaagaaactaaaaaaaattgattggtcatctgaatagagtcaagaaaagtatataacaaactcagtctactcctgaatttaaaaagaaaaccaaaaacaaacaaacaaaagccctgagcaaactatttatagaaaactcatcaacctgataaagggtttgagcaaaaaaacctacacatatttaatgttaaaacattgaatgctttccttctaagatcaggaataaataaagattttggatcttactacatctacttaacattatactggaagttttaggcacagcaacaaggtcggaagaataaattaagccatccatattagggaggaaaaattaagactataattccagaagacaagattatctacaaaatccaatggaatctacaaaagtattgctgaaacaaataagacagtcttcttatcaaggttgtagaatataagaacaatgtataaaagtcaactttatttctatacactagcaacaaacagcagaaaactgatattaaacattatctaaaataatgtaaaaaatatgaaaaagtgataaatctgacaaaagatgtgcaagacctctatgctaaaaactgctgtatattactgaaattaaagacctaaatgaatgaagataaatactattatttattaatagttagtagactcaatatgatattaagatgacaattctccctcagatcaatatagattcactgcaatagcaagtgtattgtatttacttactattgcatatcaatatagattcaatgcaatagttaagtgtattgtatttacttaactattgcattgaatctatattgataagcaatagtaaataaaacttattttgttaggtagaaattgacaagttgattctatccatatagatatacaagggatgtataatagctaaaaatgcattaataaagaaaaaagttagagaattaacaaagtaggatttaaaatgtattataaagctataataatcaagactgtgtgttattaacataaagacagacaaaggaacagaactgaaaatctggaaataaacttaacacatacgtggacaactgatttctaacaaatatgcaaaggctgtttagtagagaaagaatagtagtttcaaaaatattattagaacaactgaatgtctatgtgggggggaaaaacaactccaatccataacttataccatgaaaatattaattcaaaatgtaaaaatataaaattataaaagaaaacataggagaagaacttgtgtaaccattgattagacaaatattccttagatatgacaccaaaagtatgagtcataagagaatggattggtaaattagatatcattaaaatttaaaaacttgtgcttttcaggccgggcatggtggctcacgcctgtaatcccagcactttgggaggccaaggtgggcagatcacttaaggtcaggagtttgagagtagcctggccaacatggtgcaaccccatctctactaaaaatacaaaaattagctgggcgtggtcgtgggcgcctgtaatcccacctacttgggaggctgaggcaggagaatcacttcaacctgggaggcggagcttgcagtgagccgagatagtgccactgcactccagcctgagcaacaaagtgagacttcgtctcaaaaacaaacaaacaaacaaaaaaacttgtgcttttcaaagccactattaagagaaagagaagtgaaggcactgacagaaaaaaagaagttagcaaattatatatctgataatggatttgtatctagaaaaaaaaactctcaaaactcagtaataagaaaacattcaactcaataaaaaatgagcaaaataacttgaatagacacttcactaagaaaggtctacaaatggcaaataagcaattgagtaaatcctcagcagttagtggggaaatgaaatttaaaccacaatgagattacactatgcatttattagaaaaagaaaggttaagaaggctgaccatgttggtgataatatggaagaactgcacctgcaatgctggtggcgatgtacaatggtacactaaactccaaaaaacagttttagtactttttaaacactcttgagtatttactcagtggaaaggaaaatgtatattcatacaaagagttgtatgccaatattcatagcagctttatttgtaataccgaaagccagaaacaatccaaatgtccatcagcaggtcaatgaataaactatgctttgtccatacaaagaatgtgtgcaaactattaatgcaccctacaactttggtgaattttgtaataattatgctgaatgaaacaagccaggcaaaaagattacatactatatgacttcatttgtataaaattttagtaaatgcaaactaatctatgaaatcagataacttgtctggggacatgagattgaggtggcagagggaggattgcagggagggattaccaaggggagcatgaaaacttttagtggtaatgtatgtattcattatcttgattgtggtgacagcctcacaagtttcacctatgacaaaacttcttattgagtggtacaatttaaatatatgcagttcattatatgttagttatactttaataaagctgttaagaattaaaacacacacacacagagagagagacagagagagagagagaggcatactccaaagagaaacaaatgaaggaaaaatgtagttcaaagtatctacttaacagtaaacctctatactttaggttagattctcaatatatcatagtccagttacttttaaatatccctgttgatctgattataacagtctacctcccaggacaactgtattcattaaatgaagtaatactcattaaagctgtttataaataaactgtatggcaatattactttttattataattacccttaaaataagctcttttgtcagtaactaatattttaattaacaagatcgaatttacttcaagtaccccaattttcttttgcttgcaaatcacagtgaaaacaatagtgtatttacctgaagaatatagctaagtgaaatgtcttctcatgtgaaatccatgtatttccaatttgtacaagcaatgaagtggaaaagaaatgagagctgacataataaatagtggaaaaatgaaaagcaggggttcccattgaacagaatagtatggtaaatgagacaatgaaatttgtcaacctttaggggcttatagtatccagactttttaaaaatacttaaagaaagtaaagaattttctaagcaatgtctacacaattcaaattttgacaagtgaaaacatcagccgtaataatttattagaaatcattttagacaaaaatccagctgatttatttctcttagagttctttgcctttttgtaaacttaattcatacaaatctgatgaaagtaggttatttgtcagtgtgtaaaacttgactggtttttttttttggatcagtcatagaaaccaaactataatagaaatatggagatggttttgcaggatacttttctttaaatatgataaatcactctcttaatgataatatagagattattagcctttttaaaaaatcctatgaaatcataaactgacatcatgtgtgtgtagtctccacaaagaatgcagaccaatcttaatgatttggttcagcaaatgtttctcttgttccccatttggtgcaggctgaaccttaaacatattgaagaatagcttgaagttttagcttctgtgcctgcaactagtttttctgtcatctcggccaccactttgctttgaaccattgtttaaacatatattttcattcaaagaagggctttttaaatttaaaccacagaataaaaaatatttctagataagaggcaatgagacagtgctactaaagattgtcatatatatatttatatatatgtgtatatatatatatatatatttctaaagcacagggtgagtaggtgtcacagaataatatttcattatggttcctaatagaattctgtttatccaaaacaaatgtgttagaattttattttgaatattaactgctataaataactggctttgtatgctcctttagaaaaaaataagtgaacaacaggtaaattagacattaatcaagctttagaagaacattagcaaacattaacaaaacttgtattgctcttaaaattataatagcttaaggcatcgtaatttcaataactacattcctctattaatatttttggttcagaaaactggaatatgagaagagctttatattagcctttgatatgatgctttaccttgtaaacattcaatttggagacatgcttatagttttagaaacataaagcacttaaagttgtttagatgcactaaaacttggtattaatctctggttctcttttatattcatttaattatttcttaaactaattgaaaataattttgaggtggtcggtaccacccataattcgtttttaaagcataaccacttatttataccttttctattatttctaaaatcatcctaagagattactaacatgaaaattcacaattgaaatgattcaaaacaaagcaaccgagaggaaagatgaaaatgaagggcaagagaaataaagtaacaagaaaatgggataaactagtcacattgaataatcaataactttattcaaatattcctgacagctaaagtgaaaataaattagtaaataaaattgcactgaacctttttttttcttcagatgaaaggaactagattctgaaaggcattgcccagtagacacaaagcagttgatatgttagaccatgttttagcaaacatccactaatgcctttaaatggatagtgggtttcttgggtgcactaagagaaaattatcaattttattgctttccagtgatttgatctcataaaggaatatatcttgaagatagagtatcatttggggtttttctgtaaataaaacgtatctaaattcagtcaagcttaaatgttggtcaattcacatttgaattatgttagcattcttttctcttaataaaaatagaactcacatacacaagatgcagggatgtagatactaacattagtggctggtcatgaaaactatgatataaactttttctcctactcagacccatcacatttcttcacaggtttggttcacagggttgcttgtgaataatgttattagagaatggatttgcttggatacaacttggtaaagagattaaaatgtaataaagatacaaattgtctagatatttttggttatgctatttgttatctgtgcaacgcatagaataattggccattactggctgcaatgaaatatctatgctagcttgtaacagctgtcttggaactaaacaaactaaaaattttggagaagttaaatatgagctttgttaggcaatttcatgaggatttagaagatggtaaaacaaatcctagagttatgagaagataggtgaggtttgaactgagtgttaaagaactgacagaagttagctatgtcaggaataagaaaggcatttgaggaacagaataccacatctgtggaattagaatatgtgtcataaacctagccctcttgcattaataacattcatttcttctctttcatgacctcacaaaatctcatcatatgagtgtttctctggagaattgtaagcatatactgtattggtaaaccaacaaaaatactcgtctactatctaaccaatcatgaatactatctgtttattttattcatctatatatatatctatctaatttatgtgtatgtgagtctatgttagcataaaaactaaatatttatgagggcccaaaatgtaagtctctagtggtagttactgtagaagctatattgtaacaatgatgtatggataaaaattttacagtattagatgtctctataaaaataaatgctgaatggtactcgcaagacatcctgaatgagttggaactaggatagtaaaggaaattataaaattatggaaccctgaaagatggacaggaattaaatgcataaaaagaaaaagaaatcgaatgaaaattatacaaaaatagtaatgtataaagtatacattttcatttccattaataaataaagaagtgaatgatattttatagggcttatccagaaatacacattggaaatgttttgttggaaaatcaatctaattgagaaagtttttctgtcttcttgaatgataccattagatggaaataaaggtacacacaagaaaaataaacaattaacttctgaaccatgataaaaacacttttgaaaatattattctttaacagatacaaggatattttaaacatactaagcagaatgtccctgtatatagcaataagccaggaatacctggctttttagtgaatttcagtacattaagtaaccaacactcttattagagaccaatgtctaaaatgtcaactttgagaaacatacttcattgctgtggctttctgacccttctctgctcatatgaacagatattccacgtgcatgttacccttaaaagtctttataatctttctgatcccaaacataaaggacttaaattcagcggtttgaatttatggcaataaaaacagctatatgaagaatgttaatgtgctcagaattattgaacagacaagtttcatatccccttaaggccaaatttcactagagcctcccattaagtgtgcttaatcaaacaaaatgatgctgaaaattaagtcaattatcctgctgatttacatttgaaatgtccctgaaatattctaataaagaaatgtttaactttcttttaaatctaaatatatgctgccgtgaattgacttttagctatttattttacaaattagggtttcatttttcttacgtggaaagggaaagttaaagtaaataacttgtaaaaaaatagctttaaaattttaaaaagcatttatacagattgggtttgattaatgagctacaactgccattaaattcaaatgaaatgtgcaaataagtttaagtcaggaaatttactggttaattttaaaatgtttgtcagttcttgggcatactcagtccctggtctcggtttcctagaacttatgctagagggagaccatagacgataaatgagtaagcagaaatattattctgttaatttcagataaagtcaagtgcctagaagaaaataaaataaggtaaaatgttgtgaatgacagaggtggaggatgaagggtagagaactacattacctagagtggtcagagaaaccctcccaggggacatttgggctgataccagatgacaggaagcatctatctatgcaaggatttgcaggggggaacattcagcatagaaaaaaaatgataaatgcaaaaggccttatgcagctatgaagtgagctcagttctcctgttccaagtctataggatcacaaatagcctgaagaattgggagggttaggagagaggtcatcctctcagaataatgttttggttgactgatttgttcagcatacaattaatgtgtacctatttgccacatacaatcacacactacataattgtgttttggtcaacaacgacacatatacaatggtggtcccataggatactactgtatttttactatatcttttctatatgtagatatttttagatacacaaatacttaccattgtgttacagttgcccacagcattcattacagacacatgcttttcaagtttgtaagctgtaccatctaggtttgtataagaacattctgtaatgttcacatgataatgaaatcacctaatggtgcattcctcaaactgtatcccagtctttcagtgttgcatgtacaccgagtacagttacaaaagatgtacaagagatgttttctaagagattatattttgatgaaggcttacatttgaataatacataataaaataaataataataaaatcattttacaagtattgttataatggatctagtatagattaaatatataagaaggttttttctcattattttgtttcttatcttgaatgcattttgtaacatttgcattatacttcagatcacctctaagtatcagccaactataaatcaaccctcattttacctatcaatcagtataaatattcacatacctaaacctgcaatagaccctgtggatggcatatacgcaaggtgtggttcttgatttctttcactgtgtgggtatgtaagatagcaaatagcacctgataatgtacgaagttctaggtatcatttgaagatgcagatatatagtgcattaagttcaaaggagggaacgattgctgtggtctaagacattcatggaagaatttagaaataaaaaatttaagggtatatgtagtcttgtgaaaagaagcagaaaagcatggcctggaaatctgtgtactctcagtttacaaagttctctgctgctgtgatccttgatatagtttggctgtgtccccacccaaatctcatcttgaattgtagttcctgtagtccccacgtgtcatggaagggatccagtgggaagtagtttaatcatgggggtggttacccccatgctgctcttggcacttcttgcttggcatttctccttgctgctgccatgtgaagaaggtcatgtttgcttccccttccaccgtgattataagtttcctgaagccttacaagccatgctgaacagtgagtcaactaaacctctttctttataaattacccagtcttgggtatgtctttattagcagcatgagaatggactaatacagtaaattggtactgggggtaccaaaaagatacccaaaaatgtagaagtgactttggaactgggtaacaggcagaggttagaagagtttggagggatcagaagacaggaagatgtgggaaagtttggaagttcctagagacttgtttaatggctttgaacaaaatgctgatagtgatacggacaacaaagtccaggctgaggtggtctcagagatggggaacctgttgtgaactggagtaaaggtcactcttgctatgcaaagagagtggcagcattttttgcctgccctaaagatctgtggaactttgaacttgagagagataatttagggtatctggcagaagaaatttctaagccgcagaccatttaagaagaagcagagcctaaaagtttggaaaatttgcagcctgttgatgcaatagaaaagaaaaacccattttctgtggagaaattcaagcctgttgcagaaatttgcataagtaacaaggagccaaatattaaccaccaagacaatggggaaaaggtttccagggcatgtcagagaccttcacagcagcccttcccatcacaggcctggaggcctaggaaggaaaaatagtttagtgagttgagcctagggcctcccttgcttgtgtgcagccttgagacttggtgctctgcatcccagatgctctagctatgggtaaaaggcatcagtatacagttcaggccattgttttagggggtgcaagccccaagccttggcaacttccacatgctgttaggcctgtgggttcacagaagtcaagaattgaggttgggggacctctgcctaggtttcagaggatgtgtggaaatgcctagatgtccaggcagaggtatgctgcaggagtggagccctcatggagaccctcttgctagggcagtgtggaatggaaatgtggggtgcaagcccccacacagagtcccccctggacattgtctagtggatctgtgagaagagggccactgtcctccagaccccagaatggtagctccaccaacagcttgcactgtgtacctggaaaagccacagacaatcagccccaacccaggaaagctgacaggagagggactatcccctgcaaagccacaggaatggagctacccaaggccgtgggagcccatctcttgtatcagtgtgacctggatgtgagacatggagtcgaagaagatcactctgtaaccttaaggtttaatgactgccctgttggattttgggcttgcattgggcctgtagcttctttgtttgggccaatttctcccatttggaatgggtatatttacccagtgcctgtacccccattgtatctaggaggtaactaacttgcttttgattttacaggctcataggcagaaaggacttgccttgtcttagatgagactgtggactgtggattgtggatgcttttcttttcttttctttgttttcttttcttttctcttttctcttttgttttctctttttttttgatggagtctcactctgttgtacaggctggagtacagtggcacaatctcagctcactgcaacctccttttcctgggttcaagcaattctcatgcctcagcctcccaagtagctgggactacaggtgtgggccaccacatctggttaatttttgtattttgagtagaaacggaaaatgcaacatctgcatcttcaccatattggccaggcttgtcttgaactcctgacctcaggtgatccatccaccattgcctcccaaagtgctggcattaaaggcatgaaccaccaggccctgtcagactgtgacttttgagttaatgctgaaataggttaagattttgagttaatgctaaaatgagttaagatgcctcctcattgggaatgcatgattgcttttgaaatgtgatgacatgagatttggaaggggcggaatgatatgatttatgtgtgtcctcacccaaatctcatcttgaattgtagttcccataatcccctcatgttggagggatctggtgggaggcaatttaatcatgggggtggttagttgagtgctgctgttctcatgatggtgagtgattctcacaagatctgatggttttacaaagggcttttcccccttttgctgggtgcttcttgctgctaccatgtgaagaaggatgtgtttgcttccccttccaccatgagtgtacatttcctaaggccttcccagccatgctgaactgtgagtcaattaaacctctttcctttataaattacccagtcttgggcatgtctttattagcagcatgggaacagactaatacactcctactttgttctttgaggcatatctaagtttagagtagaacatctgatttcctgccttttgttttccctatggaagattacatgaatgaagtattactaaagcattacatgtgtatcttataaaactaagatttaaatggcaggattaataaagtatttattaaaaattcaacaaattgagcctattatttttatatacctatatctgatcccttaaagacatctaggacaaaattccaaatctgttgtttttgtatatgttcagttaggaaacctactgaacctcgctcgtcaaaattaatgcattcaaaattgaatctatgtattttttattaaagagccaactttaaatctctatggtaacgactgcaataaatgtgcaacatcttaagctatgattatattgtcacacttagtgatgtctatcttcattacatgactaccaatcgttttactgttgttctagtcaaccagaaatgtagttaaaaaaggaaaccaattatgagatttatttaaataagaccgaacaatttctgcaataacagattctagatactaggactgactctgagtgtgtgagataatgttgaggggagaatttcatccaactgtaaaaaattgagtggtaagtaccaatacgtaattactactgagaaattaagtataattgaaaagctagttgttgattttcagtactacccttaaaaattatattcaaccaaacaatatttacaacattttcaaaattccaaatttgatgcattaggaattctaaagatgttttataattgtcaaactaaccatgtggttacactgcaaatatgccaaaattgaaataaacatttttggtatggaattattagcatttctgtactgccaccatgatacacctgcatgtgataatatatttctgcatgccctactctatcatcaaagttttggcaacattttcccacttacttgcttactccatagcctagtaatatgtgatccctgaccaaaatattttttctctattttaagtggtcaaccaaattctatatttactttttaaaatcctatattttagttggtcaaccaactttatattccatattattaattggccaataaaagctatttgcatttgcgaaaaacatcataacttatggaattcctaaattaagataaaaatctatacaaaactttaagcgtactgtgtcccacactaatcctgtaatggtctatttggatagtaattagacctgatggaagactactgctccttcatcatttctctgaccctacaagagaagacctcaggaactgcaagatttcttttcatatttggggaacaaaatggaagctcttgattctataaagttatggaaagttaaagatgtaccaggagcagttggaaatgtgttgcagggttgaggcaaaggataaggaattaaatgggtgtatgaggattgattaatttgccaaggaagaaaatagggacagcaaaagagcaaggcatttccttaggtagcacctactttaggggtgggagaaagaagaaaaagtgattgctaagtcaaaactgtcagtgaagaacaaataaaatgtcacaaaaacttagaaagttatggtgattgtcaacagtgtcaaatgctacagagaagtcaggaagtaggaataatgtaagctcataaaaagtttcatgagcagtttcagatgatggattcaagatagtggaatataagatgataagataattggattgtgaaaacatgtagtgggggaaaaatctttttaagacatttgcccgcaaataagaaggaaaaatcatagtaactttaaggttaaatatgagcaaagtaattattttgtattttctatcatttcattttatcataaatttaaaataaaatatcatctattatattttagataggtaaaatatctaaaaatgaataaggaactagttttaaatatgcggtgatatctaaaaagaaaaagaaagggataattgatgagataaatacctacaggtattggacaaatggtatagcaataaagaatatctgtgtgacacttagtttacagtgcagtttcacactcattattttactatgtccttaccagaacactctagatgagttcttattatcatcttattctatagttgaaggttctgagcctcagataaattgtcatgtgcctagaaattggcagggctaaacatcaaactcacatctcctgactccaagtcaggaaccttaatacgagttcaggagaccaagggcaagggtgaacttcagagaagaggattgactttctttcctaaaatggaaagaagaaactaaggatatttgagacatttcgaggtagaaatgagtagaaaatcaggtgagctctttttgatctcaaggaaagtggaggcaagagattattttcagagaagatagaatttatatggagcttgataacaggtgaaaattttggattaatcacagcttcttcaacaagcatttgaatgagcatttgatgttctctatggagcaacttttaaatttcacaagaataacattttgaagtactagtgtaccaaggaaattatctttactggactttaagcatcatatctaaagaaataaactttgcactcccctctccttgtttgtgactgacaagttagcaaagcaatatgccaaatgttgctatttcatggttatttctttactcttctaaagtgtaatgtaaccttcattgactattaccaattaatttttttaataaaaaactgtcaaaagtagagtattaatttccttcttaggatgtttgtgggtttcttgaataagtacttgaggtgacattaacatggatatttttaggtgtttcacattggttcttgccaaactctatatagcaaaaaaaaaagtgcctgtaagatgagttttgagaggtactcatattttccattgacagcattagaattttagatatgccccctagggaaagtacttatttgaagcaaaacttacagctttaaaaaataatgtcttaggttcttgactagaaacaaaatgactctagctgattaaaagccaggagaaaggcatcctgtctatcacgatggtgggggtgagaaactctcaagtccccttcttgtaagcatgagagactgtttatttatttatttcactgtcaaatgcaaactgatgactagactttaactttaatatgcccagttttgacattcacaactagactggcctgtaagctactagagagctatgtattattattattctttttctatgccccagagcccagcattgtgcttgacaacacacaaagtaattggctaatatatatttgctgaatatatgccagccaggatcttagaaaaaaattctcaagaggagacaggttgtcctatttcctcaaatttatcacaattctctacatttgggacacacatgaccactttacaaattacacaggaaatttaattgaaactgaaattctgtaactccaattaggagaggtggacatttacagatggagagactgaaggaaaactttttctgagctaccaggttttcttttccactcaagttctttttatgtattgctggcatctgtgaaagagcaagagatgccatatattgcagctgggtacccaggtggtctactgatattcaaaggggactggtttggcatgaattctagggcagcgtcacgcagctgtcatgagccactctgtggctagaagcagcagatgttactgatatctgaaaggcagtcacatcagacatgggagaagaccaatgtaaaatgcaaggtatctgacctacatatcatttaagaaatcacacacattttccattcagttttcaaatttacatccacatacaatttttttcacagttgagagtaattgataggcttaattatacaacgaggaaaacaaaaattccaataattctacttttgtcttaataatcacttaaatatactgaaaatactttcaaagcctccaggatgtattataccttaacattattaattattaaaagatgaaaaagtgttactgtatcatatattatttttgtttcctttcttcatgagttactgtttgaaacaatttgtgctcataaaaaagcaatgcttgtttataatgtgaaaacctaaccattaatttcttaagcagaaccatcttatattatgtaggatttctaatatctgacagatggccttacattttttatttcttgcctgttatattcatacattttatttacacagagaacggaagatttgccacaatacaatcagaaccatgtgttgtattgttgatctaaaggacaattgggattttctgaaatatcagcagccctaataagatgtggagtaatgacatgtaacaatttttctgattccagaaaacacaaaagccataaagtgtggtgatcaatcctaaaggtcagaaaactccaaggcaaagaaagttgtcgaaaggcaaaaagtgacagtagattgtacattaggaaatgttggcatgagtattttgggggtagcttcactgtgtttttgagctgctaggaatgggtttctggttttgagaggagtgggagatgagattaaaggctccatctgtgatcaataccacttcaccatacctctcacacacaccggttcatgcacattttgttcttaaacacatcctctccttcaactctacattcagtctatacacacctttgcattctttcactctactttttcctctccctttccgcacccccactctgcccccaccagctgctccctcaaaagtcagttgctaggcctttggaaaagcaaaagataaagtatgattgagaggcatcctttaaaaaaacctacttcaaggtcaatttgctaattcctttagaaaatgagtaagtatgaaaaggatcattttgaatttggggctttcaggaacttcattactaaattaagacagaaagtacttgataagggaaaatacttgataattggacattttagaagcaaactgacattggtgggataaatacatgggatggattcaactcagcattgtctacgtttaatgccaactttaacatctccaaattaccctaataaggctatgacctgaaaaattctcctaaaggagaacaaaagtgctcttccattttttctcgttttaaaacatctgtgagctttctaaacgagaggaattcccatatttgagggggaaaaacacatttattgcctcataataagttttatagtctcagctcctttattctttctcttgttcatagaatcatatttttattatattcttttaatacaactaaagtaaaataagcttgcctaagtaggaaaagttttatttaaatttcggagggttatatcattcccatctaaaaatatgatctctacaagtggtttgtgtaccctaggtaaaaagactaatctaaatcataaatatatggccaaaaacacaaagccatcatcaacctcattccctcttcttctgcatgtgagttttctaaggactctccagattaaatgacttgttccaaattctacaatcagtttgtgtctatttcaagaacagaatgcagctttccaattttaaatgtgatgctttttttattttccatgcaaaatattttgtttaaaaaaaacattaaattatcaagtattggaaagaatcctcaggtgtgctgaatctccctctggcttctggcaggtgaccacttaaaggctacaataacttgatgtagaaaaatcttcatcttgagatgttatcattacctcagacttcaactctagccaccactcccaagtaacataaatctagattacactgtgaagttaaaaataggtcaagagtcaaccaaacaactaagaaggcattctctcaatcaaaatgacaatgaagaaaaagtggcaagtttcatatcaagaatgaggagaaaaatgcctactgtaacctttatgtctgttccatttgaatgactttcatgccttttgtgtttgtgcatgccagtttatcaaggatcatagtgccttcagcatctcaatgaaggcctttttagactttgtttcaattctaagaattacgggatttgtcatcaggctacttgaatatatggaaagtggagagttgatatactgatagggatttttttttattatttttgaagcaaacaggaatatggaacaaaatattttgaaaattaagtcaccagtatcttcaagttttccctttaccaaaattgagaaaataacagctgtttttcctgattccattacatggtagatacattttgtgtgccttgtgtaatttttctcatttttctttatcaatattaatagatcaatgatcaattattattgagcactgatatgagctaaactttttttagactttgcaaacactgagagaatggtatctttaatttctgatttttttactatatataaattatacttcgagatcgcaccactgcactccagcctgggcgacagagcgagactccgtctcaaaaaaaaaaaaaaaaattatacttcagtttcataatgtagaaacgtgatgctttttcttaaagagataacatgagtggggctataaggctaatatatacaaaatacacacacacatacacacatctatatgtgtgtgtgtgtatatacacacaagcacatacacacagcctcacatccacatacatatacatgaacatttatctagatgacaaactatagaattgagaactcaatggggtgatatagaggtaggtagatagtaagttctataaatcagtgaaaatttgagatcaatgaaacctatcatagtcaaaaactgtttacaggaagaaaacaaatgtgggctgtgcctgatagggaggacataataggtaagggaaagtacgtatattcttttatttttatgtttatttgtaattaacacataataactgtgtatatttgtaagatacattgtgttgttagatctgtgtatacattatagagacaatcaagtcaattaacatatccatcacctccccaacttatttttatatgtgtgatgagatgttaaaattatactatttaagcaattttgaaatacaaaatacatcatcattaactgtggtcaccctgcagtgcaatagatcactaaaacttattcttccagtctaactgaagttttttgtcctttgaccaacatcttctctttccccatctctccccgattccctgtaatctactttctctttctatgagattgactcttctagattcctcatgtaagtgaatttataaaatattaatctttctgtgcctggcttatttcacttagcataatgtgctccagttccatccatattatcacaaataacataattcccttccttttttcagctgtgtaacatgccattgtgcatatatatatatgtgtgtatatatgtatctgtatacatatagctacacacacacacacacacacacacacacacatatatatgtatctcacattttctttatccatccagccattgatggcaggtgctttggttgcatctgtatcttggctattctgagtaatgctgaaatccacatgagaatgcagatatctccttcatatatgaatttcaattcctttgaatatatacccagaagtgggattgctggatcatatcgtaattccagttttagcttattgaggaaccatcaaactatctcccaaaatagctgtacaaatatacatttccaccaacagtgtacaagggttcccttttctccacatcctcatgtggagagtgaggattcggagaataactgtgaaatataacacttattatcattcatcttttttataatagccattctaatagatgtgaggtgatatctcatgtggttttaatttccatgtctttaatgattagtgatgtttcacattttttcatagatgttagtgattcatatctttttttgagaattatctgttcagatcacttgcctattttgaaattgggttattaatatttttgctgttaagttgtttgaattccttgtttttgatactagctctttatcagacatatggtttgcatatattttctcccagtccatgagttgtctcctcactctgttgtttcctttgttatgcaagagctttttagtttgacacaatttaatttgtctctttttgcttttgttgcctatacttttggagtcctagccaagatatcattgcccagactaatatcatggagttttttccccatgttttatttgagtaactttacagtttcaagtcttatatttaagtctatattttatccaatttgagttgatgtttgtatatggtgtgaaatagtacagttttattcttttgcatgtggatatcaagttttcccaatgtcacatattaaagacattctctttccctcattatgtgttcttgccacctctgttgaaaatcaatttataaatacttaggtttatttctgggcttttgattctgttttactggtctatgtgtttgtttttatgccagtcccatgcttttttgatttataatagctttatagtgtattttgaaatcaggaaatgtgatgctcaagctttgctctttttgttcaaaatttctttgggtattcagagtcttttctgcttccatatgaacttaaggattattttttatatttctgtgaaaataacattgcaattttgataggttttgcatggaatctgtagattactttaggtaatatgaacattctaccaatattacctgaccatgggatatatttttatttatctatgtcttcaattttttagtcaatgttttataattttcaataaacacatctttcacctccttggctaaatttactcctaagtattttttatgttattgtaaatgggattgttattttccatttctttttaagatagctcattattaatgtgtagaaatacaagtgatttttgtattttgattttgtgacctacaaatttgtttatcagttctaacagtttttttggtggagcttttagggttttctgcatataagatcgtgtcatcagcaaacagagataatttcacttcttcttttcatatatgatgtctttagcttattcttgcctaaatgctctggctaggatttcaagtgctatgttgaatataagtggcaagattgggcattcttgttgctgaccttacaggacaagctttcagcatttcactgttgagtctgatattagctgtggccttatcatacatggcttttattgtattggggtacatttattctatacctagttttttgagagttttaaacataaagcgatattgaatttgtcaaatttttctgcttctactcagatgatcatgtgctttgggttcttcattttgttagacatgccttacaagaagtactaaaaggagttattcaacctaaaggaaaagatacccctaagtagaaacaaaaatatataaaaatatggtcagagtggatgcaggtgtgagagggtccagcagaaggaaacatggctgccagcatgtttgagtctattaacaagtttggcctggccttatagctgttgtaggaggcatggtgaactctgccttatacagtgtgcatgctggacacagagctgccatctttgactgattctgtggcatacaggacattgtggtacaggaagggactcactttctcatgccatgggtacagaaaccaattttctttaactgatgttcttgaccatgtaatgtgccagtcatcactggtagcaaagacttacagaatgtcaacatcatactttgtatcctcttctggcctgttgctagccagtttgcgcacatcttcaccagcatcggagaggactacaatgactctgtgctgccatccatcactaccaagaccctcaagtcagtggtggctcactttgatgcaggagaactgatcacccaaagagagctggtctccaggcaggtgagtgatgaccttacaggtcatctttgggctcatccacccacctttgggcaagcagccacctttggatggcatgtccttgacacatctgacctttgagaaggagttcacagaagcggtggaagccaaacaattggctcagcaggaagcagagagggccagatttgtggtggaaaaggctgagcatcagaagaaggcagccatcatctttgccgacggcaactccaagacagcagagctgatccccaactcactggccatggcggggacagtctgattgagctgtgtaagttggaagcagcgagacattgcattccagctctcatactctgggaacgtcacctacctgcctgtggggcagtccatgctcctccagctgccccagtgagggcccaccctgccttcacctctgagggccaactaggccacagcccagtgattcttaacaatgcttccttttgcccccaccccagattggatgatttccaaatgacctgttttctagttcatcaatccttcttctgcttgttctacttggctgttgaaaccctcttttgaattgttattattatattcttcagctcaataattcctgtttggtgttttctaatatttcctatctccgttttaacgttcagtttgctcatgtgttgcactccacacctcagtgagcatctttattactgttcttttgaactgcctataaagtaaattctatgtctccatttcatcaaggttggcttctagagatttatcttatcttttatttgaaatgtattttcctatttcttcattttccttgactctgtgggattcagtaccttagataaaagaaccacctctcccagtcttgctagactggtcttgcgttggagatattcctcccaattagtatagccggagattctaggtgcctcaaaacactttgtttgtccaacctgctttgcttttattggtccctgtattagtccgttctcacactgctagtaaagacatacccaagactgggtaatttataaaggaaagagatttaattgactcacagttccacatgactggggaggcctcacaatcatggtggaaggcaaaggaggaggaaagtgacatcttacatggaggcaggaaagagcgcttgtgtaggataatgcccctttataaaacatcggatctcatgagacttactatcacaagaacagcagcatgggggtaaccacccccatgattcaagtacctcccaccagattcctcccacaacatgtgggaatcatgagagctacaattcacgatgagatttgggtggagacagagccaaaccatattgttccacctctggcccctcccaaatgtgagcccctcatgtcctcacatttcaaaaccaatcatgccttcccaacagtcccccaaagtcttaactcatttcagcattaactcaaaagtccacagtccaaagtctcatctgagacaagccatgtcctttctgcctataagcctgtataatcaaaagcaagttaggtacttcctaaatacaatgggggtacagtcattcagaaaatacggctgttccaaataggagaaattggcccaaatgaagaggcctacaggcttcatgcaagtctgagatccagtggggcagtgaaatcttaaagctcccaaatgattccgttgactccatatctcacatccaggtcttgctgatgcaagaggtgggtttccatggtcttgcgcagctccaccattgtgattttgcaaggtacagggtacagctccactccttactgctttcacaggctggcacggagtgcctttggcttttccaggacatggtgcaagctgttggtggatctaccattctagggtctggaggacggtggccctcttctcacagatccactggacaatgcccaggggggactctgtgtgggggcttgcaccccacatttcccttccacactgctctagcaagaggttctccctgagggctgcacccctgtagcatacctctatctggacattcaggcattttcacacatcctctgaaacctaggcagaggttcccaaacctcaattctggacttctttgcacccacaagcccaacaccatgtgtaagccaccaaagtttggggcttgcaccctctaaagcaacagtctgagctctacatttgccccttttagccatggctgggatgcagagcaccaagtcccaagactgcataaagcaataaggccctgggctggcctatgaaaaatttttttgtcctaagtctccaggcttgtgatggtaccaatttactatattagtccattctcacactgctgataaagaaatacccgagactaggtgatttataaaggaaacgggtttaattgacttacagttccacatggctggggaggcctcacaaaatggcagaaggcaaaggaggagcaaaagcacatcttacaaagcagcaggcaagacagcttgtgtaggggaactcccctttataaaaccatcagatctcatgagacttactcactttcaagagaacagcacaggaaagacccacccccatgattcaattacctcccactgggttcctcccacaacacatgggaatcatgggagctgcaattcaaaatgtgatttgggtagggacacagccaaagcatatcaatccccaagaaattagtgattgccaagtcatgctattgccttgagagagttggaatagcacccagtctcttgggattcagctagagaggctacagtgttagaggtgtgttccagtttcttattttcttgcagagaagctgagagccaaagtttgtcccacttattctgtccttcaccaaggagacagcctgaagcagctgcctctgctcataatcagaatgctcactttgagtctagtgagagagatgctgaatatttccaagtttaaaagtcttttcttgttccctgtggtctaggagactcaggagtgcagagctctgtcaactcccatagctaggtgatttaagagccattctcttgggtaaaggctataaaagttggggcactcaatgcatgcacaagctactcccagtgagagtctgcatatctagatttactgccggggcaagtcagggaaaaatatgcagggagagcccactctcccattcaaacaagtggaagtctcacaccctcctagcaggggaagaatgtagtccagaattatcactgaaacaaagcagggaagaaggtgcagggaatgcctacttttccattcaggaatgaagaggtcctccagtctctctttaatgagagattgcagaaatttatctcaaaagcaagccaaggaaggaagcaaggggcatgcccactctcctgttaaggcaagccgaacttttacatctctcttgccggggtagactgagattacaggaatttatcttaggagcaagccagagaagaatgtacatacaggacatgccttcctttctgtttaagctggaggcggcttattctttattggctatgtaggttcccagatactggcttgttaaaaggccagaaccacaggaagctgataggaaagcctgagaccaaatttgggggaatttagaagctgggccaatcctcagtgctatagctgctaggagggctcatgttgtgtccagaattggtggattcttggtctcactgacttcaaaaatgaagctgcggacccttgcagtgagtgttacagttcttaaagatggtgtgtctggagtttattccttctgatgttcggacgtgtctagagtttcctccttctggtgcgttcatggtctcactggcttcaggagtgaagctgcaaccttcacagtgagtgttacagctcttaaaggtggcgcgtctggagttgtttgctctttccgtccagagctgttcgtccctcccggtgggttcgtggtctcgcgggcttcaggagtgaagctacagaccttctcggtgagcgttacagctcataaaggcagcccggacccaaagagtgagcagcagcaagatctatcgtgaagagcaaaagaacaaaccttccacagcgtggaaagggacctgagtaggttgccgcggctggcttgggtggccttttattcccttatctggccccacccacatcctactgattggtccattttacagagagctgatttgtccgtttcacagagagctgattgggctgttttcacagagtgctgattggtgcatttacaatactttagctagacacaaaatttctccaagtccccaccagattagctagacacagagcactgattggtgcgtttacaaaacctttagctagacacagagtgctgattggtgtgtttacaaaacctctagctagacacagagtgctgattggtgcatttacaatcctttagctagacagaaaagttctccaggtccccaccctacccagaagcccagctggcttcacctctcaatggcactcgctgggggactttgcggcacctagcctgggcactctggcagcccagagagagcttgtcccccagtcaagcccagcaggtgctggccggccacgctgggtgcggggcccaccgaacccatgcccacccagaacccggccggcccacgggtgctgcgtgcagccccagctcctgcccgcacctctccctccacacctcctggccagaccagggagctggctcccgccttggccagccccagagaggggcccccacagcacagcggcctgctgaagggcgccttgagctcagcaagagcggacgctgaggccgaggccgaggaggtgccgagagcaagcgaggactgctagcacgttgtcacctctcgatgtgattcaaacctttttgttttttccttttatgtttgagataaatcttctgatgccctctccctgtggttcatcaagcatggtgattgaagagccgagccctctgtaaagactgcaaaagttggcactttatgtgtcgtacaagcaagccccttacccctcaggaagaagctggtagttgagatttttcctctcaattgtaaggctctgtgctctgggtggagctagtgtatgagtgtatttctgctttcaatatccattttgatgtgagtatttctcagtagtctggcatgtacgggtctttcatctggattttggctttctcttggagagaactgactcatgtttaggtgtatactagatgtgtctgtgggatgagaggtagcccagagcctgctctttcaccatgttgctgacataccctcatatattatttcataattttaatttcccaaattgtatcaagttattaaattcctctctatttcactgccatcaccttgggcaaagtcattatcatctctgttctagattgttgcaataactcctcaataaatcactcatttactcaattccaattcattgccaaataaaagctaagtatctttatgtgaattagtttgccttaatcctcataacaatattattttaccaggtttgctgggctagattcttctagtttcattttattatctgagacccaaatcacagaaaaatgacataactgaggtcacccagctagtaagttgcagagctaggatataatatcaggagctatagcctctactcataatcattgtactatatggtctccattattatttgttttcaataagactatattaaaggatgacttcgtgccagaggtagtatgtttatgggttaggggaaagataaagattaatataaaaacaagcagctgcatgaatttggtacaacagctgtaaaattagaaacaatagtagcactggaactgacattgcaaagtggagcttatgaagtttatgaactttaattaaaatgtcactgatgtgggtgccaaaaatcatgaaaaggataaagtatgttcgttaattgtctcctagcaggggaaatagagtagataatcaaatgagcaatgggcattttacattttgattaagaaccttctccatcataagacatttataaaaatatctgagaacaaagacaagctttaattccctgtggataataggatagtttatattgtatacatggtcaaatttacttgaaagagataaaatataaaatattaatctgttgaaagcctagaaaataacaatctgatatactcagtgatacaaagtaattcagatatcacttgttcatgtgaatgagacatcatgttttattcagcttatacagtttgttcagacattgtaaaataatttcagggaataaaatgcggtattctaattagaagctaatagactattattttagactccacacagtgtacataactcctggacattgatgttgtaattttaaagaaacacaacatttttaagacctgaataaaattctttttaaaaagcaagaatcagcgagtaatctatagatgttgatttccctgagaaattatggcaataaaagttaaataatatccaagtatcattttacttcatcccatatcaagtgccaggcatagttccttgtttctttacacataaaatcttgttagagtcttggaagtagtcattattattcccactttccactgggaaagttaaggccttgaagacttaaataataattttcacaagtatacatagcatgtgacagagcctgtagaaaaattctgtttgcttatttcatagcccaagttcttaatgactgggtcataatgttccttctttcttttctcactgccttttaaaatgttgagggtacaataaaggaaattatcgaggtagtcattgtggactccactcaatttgagttctttctgctttaacatttatttttttcacattaccgtggagtctaaatatatgacatttatctggtcaatatttcataagttaaatgttttattcttgtattagcttagtattactatgagtagatattaacttagtattactatgagcctaattaatgcatagtgttatgcatttctaccttaatctttttatttttgtgcaaattttgaggagaggctttacctaggaaatgcaatatcagcatttatctacacattctgtgagcacagatggctgatgggagaagcactcacattatttcaagagtcagtagcctatggcatacaggcaaaacatgagccagtatccattgagttatggaacagttgccaccacttctttgtatctatcctcaatatatttaagaaatgcctttatctgtgagaatcaaagtcagacaggttttccttgtcttacaaatatcaatgcttgcagcattatacctgtatatgtacataaaaatgtcattacatgtcaggagaataacataaaatctgaactttcgtatatccttatctttgccaattaagatggaaaggagtgagaccattggaaccctactttaaaagatttcaaaccagatttcatttcctgttctgtgtgcacgttcaggatgtaggggaaaacaaaacaatatcttttccctgcctgtcacaaggtttatgaccaacactcttatgaaaaagacagacagattcacaaaaggaaatcatgacaaatttatttaacccaagttttatgtcaaatgagagccttcagaaatgaagacctaaagatccaagaattttcatccttaagcatttgtttcataactcaatgacacttttatccttaggatccaagaagaatggacagtcatatagaagtatgattggacaaaaattaagtgtgatctaatggaattaaaggaggcagggcacttagcaaggtctgtttgttcagattcttcttggcctgcaaatatagggcagaacccctgtgaaactagagtcttatgatcttcttttaggaaaagtaagtcagagaatttctttatggctatacttcagggtagaaaggtgggagaaggtcagaatggcctcctggctacggcagttttttcagttgccaacttgacatattttggagtattatgttcagagccctgatattggcagagaaccaataaacccacaacctatgggaggaccaagaagcaacagagtggaaataaagagccctgtgcatctaactcacacaaccatagtgctaatccatatttatagaaaggcaaatggagagtcatgaggacaactgtcagtcagtagtttatattaaacagggcttagtctgaatttagtggagtacagatttaaaatgacttttttccccccaattattgcttttatgctctgaagaatactcattttcagtccttaatgttatttagcactgattttatagctttgtaatcacttctcgttattgaaaattctttttattttatttatttatttatttatttatttatttttgcgatggagtctctctctgtcacccaggctggagtgcagtggcgcgaccttggctcaatgcaacctctgcctcccgggttcaagtgattctcctccctcagcctcccaagcagctgggattataggcacccaccaccatgtgcccagctaattttttatttttttatttttagtagagacgaggttttaccatgttggctaggctggtttcaaactcctgacctgagatgattggcccacctgggcctcccaaagtgctaggattacaggtgtgaggaaccatgcccagccattagagaaagctctaatgtccactgtaaagccttgatttttgtaggcacacatagctcacattctcttctctccctaggcccatgatgaaagaggagcttggaatgagagagggcaggggtttgtgggttgccttccccaatgggtagggtgaaatgggaaggctagaaaaacggcaggtcttttctgataagtttgatgatggcttgccgttgttggcttcatatggttccacttgctattggtggccttacccaggtgattatcttctatacatagttttactgttttcttaaaactgtgctcagcttcagcctttatttcttctcttttccaagggccttttggagaggaagatcttagtctctatttcacccaactgcctttctcaaagtgtgcctccttgctgatctgccatattgttagtcccatagctcattctttcttttctatgttccatgctctatagagcccagaaatgactgaggtcttgtccagatgctattaaagaccacttcctccaaggttcactgcatcactggacctatcaattctgctggaacaacctgtaaaataaaccccaaccatagcttcagaattcactagattgggagtggtctctcttttactagggtcatgtagctctctgaacacattcttctctgctctaaaggcagcaccaggataacgtgctaatttgctgtacaactgtccagctgggagagaaataccagtctctccattcagttagctcccttgtttgggtgaaggaggaaagaagctcttcatttatgagtattccataggaagggagggaaaagcctctttaccaaacaccttgcatttttcacaataaagagaagaccttaaattccgtctcatgtataacaagtcgtgtcatttcttctgaaattggagcacctttcctggtcacagaatgaatgttgagtactctactaaatcatgtctgagagagagagaggaatacaaataaacaagttacagattgtggtaagcaaagagggaactaaacagggttctcttagagaaaataactggggtggggctactttatttttattttatttttttaaagattctttttttttgttattatactttaagtctgggatacatgtgcagaatgtgtaggtttgttacataggtatacacctgccatggtggtttgctgcatccatcaacccgtcagcaattggagaagacctctctgatgaagtgatgtttcagctgagatgacaagtatggcaaagaggtagccaaggtgaagtgctgacagaattgtattccgggtacaggggaaggagatttgagaatttggtgtgtgaaaaggtatgtggtatgttattctagaatgtggcagaaggccagtatcaccagtgttttttgacagagagggagaataaggtatggtcttagaggccctgctaaaggattttgtttatattcacagtgcaatgagaaaccattcaaggatttaagcagggaagtaaaattaagtaattaaatttttaaaagaccactttgatttctcactacaaaacaaattgcagaaagcaacactgaaagcagcaagacaattaagagtctgttgaattgacagataagagatgctggtgattaggacaaggatggtggccgcggaaacagagagagggctcccacaaaattcatgtattgaagccttcaattactgcctcacatatggcctgtgaggagggaattgaagataaatgaggtcagaaaggtggggtcctaatttgataggactgatatccttataagaagagaaagaaataccagactgctctctccatgatgtaaggacacagcaaaaagatagtcatctacaagtcagcaagaacacccttatgaggaactgaccatgctggcaccttgatctttaacttcccagcctatagaactgtgagaaagagatttctgttgtttaagcctcccaggattttgttatggcagcgcaagcaaacgaaaacagatggctatatggagaattattttacagatagcactactaggatttaataatagattgcatatgcatacagatgatgaaagaaataagtcaatgatatgttctagttttatttagttatttattttactttacttgtgtatttattggtttgactatctgggtgaatgttggcaccatatactatcaattggaaaaaaaaaatagaaaaaaataagacctggctgacagaacaggggtgaatcaacaaaccaagtttgaacatttctgtttgtatgtttctgggacatacaagaggaggtatcaagtagatgtatggatacacaagtctggatcccagaaaagaggtctgggctgagatgtaaatttgagattgttggcatgcaggtcctatgtaaattaatagtaacaagtgagaccacccatgaaatgtataaagagagatgaaggccaacatttaaatataaatttaaagtaaaaatggataaacatataagaagaggaaaatcaggagactccaagaaaacagtcaacaagataataaatgcatcaagggatatttgttattttgaccagaggaattgtgaggagctacataaataaacagtattttttacagtaggtcaaaaacgaatgtaaattgaggaagggaaagaacatatatcactaaatacatatataatatcactaaattacataaatataatttatataaatatataatttatatataaatatatatgaaatatatataaattatatataatttatatatacatatataaattatatataaattatatataaattatatatacatatataaattatatattatatataaaattgtatatatttatatataaattgtatatataatttatatataaattgtatatataatttatatatacaatgtatatattaatttatatatacattgtatatataatttatatatacattgtatatacaatttatatatacattgtatatacaatttatatatacattgtatatacaatttatatataaattatattatttatatatagtatatataaatatatatactatatataaattatatatttatttatatattatattatttatatataaattatatattatttatatatacattatatataaattatatattatttatatatacattatatatacattatatattatttatatatacattatatattcattagaatcttaattgtctttctgctttcactgttgtttcctaagaacatgtatcgctaatatgctaaaattacataattcataattctaccgtaacaaaaatataaaatatatattacagatacaaatatattatatataaaatataaaatgtagataaaatatatattttatattatttaatggtaaaaggaaacagataggatatagatattaaacaattgattttttgtgtgttttataaatttttgaagctatttgaaagatagacgactttagaaggtattatgcaaagataggcataatctagtaatgagaaacgttaatatttcaggagaaaagcaagggaaatgactaaattagtgacatccttaagaaagatacaagggatataatggaggactgaaaaagaatattgatttatctgtgataggatagcgattaactgcctccattttaacaggaagaatgtaaaaatgtgcgtaatcacaagaaggttcatatatttcatgaagctaggaagatgaggaagttatcaatcaatgaaatactttttttttttttttttttgagacagagtctcactctcgcccaggctggagtgcagtggcgtgatctcagctcagtgcaacctccgcctcccgggttcacgccattctcctgcctcagcctccagagtagctgggactacaggcgcccgccaccatgcctggctaatttttttttttttttctatttttagtagagacagggtttcactgtgttagccaggatggtctcgatctcttgacctcgtgatccgcccacctcggcctcccaaagtgctgggattacaggcgtgagccaccgcgcccggcctgaaatacgttgattatttaagaatgagcttccctgtcttttaagggggaggaaggtttctattcttctcgtatattcatctgtatttcagtgtttgttggacctatttttctgctagcattacactgtttaaaaattataaaataaaaaaatagatttacatgaaatgcacaaaccattattgattattatgacttattatttatcatcttttatcttctgataaaaaaagtggttgtctcttactgctacccaagtccaatagcagctcttttctaagctaaatgttatctgaagggtcaggtgaaaagatagtttttttttctttctttctctcttttttttttttttttttgagatagagtttcgcttttgtcacccaggctggagtgcaatggcgcgtgatctcggctcactgcaacctctgcctcccgagttcaagcgattctcttgcctcagcctcctgagtagctgggactacaggcgtgtgtcaccacatccggctgatttttgtatttttagtagagacgggtttttgccatgttggtcaggctggtctcaaactcctgacctcacatgatctgcccacctcggcctcccaaagtggtgggattacaagtgtgagccaccgcacctggccagaaatggccagaaagatatttttctttcaaaaaaagtaactctacttaaatcagatgtatcaaatgaaaacaatgttagttacagtataaaaccatgttttccaaattttgtaaaacagcgactatgacttctatttattgtgacaagaaaacctgtagcatatatgttatatatatatataattgtatgtatagtattgtgtgtatgcacatatatagaaatagtataagctatgattatacaacataatttcatagaaatcagtattttatggctagtttgcataatacttagcctcaaatacacagtgaattctaggatactaagaaatatatggtatattttctaagaatttatagttttaaaggagtgataaggaagtgaataattgtaatcagtcctaaaagcatgcttaaaataaaaaaggtacacattactaaatctccccccagagctttctagaagaaatgatcttggtgaagatgagttttgaaggatatgtagaccttgagcacctataaaggtgccctaacacatcttaataataaatccaaaggcttaagatgcaaggtatatgaccagcttagaatgaatgatcgtttataattccagatggatggagagtaactgatttttctccaaatcaaatttagtttttgacaatggcatgtaacatgtacagattcattaatagcagatttgggtaccaaatctactaactagcaattaggttaactactagaaactagaaattaggtattctaataaagagacatacattaaatgtgtcttacctccataattccaatgctacaagtatttaaatatatcaagatcttccaaattcgcatcctttgccaaaagtaagtatagtgtaccagttctaaattttgcatcagatatttgcttgaaacatgtaaaatacgaagatttggcctaagcttcagttgcttcatctcatacaatattattgcattatttacaatgattgttccttttcccagatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtacacaattctgacatttttctttctctacaggagaaaataaaattgaaacatactgaatatgtgtttcattattgctgttattcttctagttaaaatattgtttattaccataatattgcagaaaacggcatatgagaaagttgtactatgaagtaaattttgatgtaaaataagaactgtatttcaaacacctaaatattatcttttttttttctcaacccaagtgttatgctggaaaattggagcaagccatacagagagatctatatttattattaactcgaattaagaatatttttaaaaatattttagtaggggaagattaaatgacttcatacagaaacaagatggaaaattatgcagatatttaaatttatatttctgaagaacatagtaaattatcaataaatatgtgtgaaaaataatatgagtaaaacgttttcatactttagttacagagaagtatatatattgaaatagaagtaaacataggctatcagtgggtggtaggattatgggtaattcttttccctatatttttatatattttctaatattcatacattacttattttaagaattgaaagtcattaaaaaggaaaaaaatgagaaaatcctattactgggtggtgggattattaatgattacattctgtataattttctagatttctgcaatagctacattacttaaaacaaaaaaagccaaaaactgaagcatttaaaaagggagaaaaataaggatacaaaaggactgtttttatataggccttatggtcattagtgtcattattgtcattattatgtaacccatcaggacaacaacaaaaatccaggcctacatcctctttctgtaatacaatctattagctggcttagaaaaggctatttgattttaattggcatgctctgatttttgaaggtatatttaagtgtcaatgaaaagagtcaaactctgtaaaacatttagagctttactctgaaccaaatttgagtgaacctggcccaaggcacagtctggagagttccagagaacatgtgcccaagatggttgggttataggttgatgttacacattttagagagacataagacacatcagtgaactcatatgagggatatattggtttggtcaagttattgtctaaatacctagactcaataggaaagagtgactgggttaagataggaggttgtggaaaccaaggttcttattatacagatgaagtatcattggtggccaccttagaggcaatagttggcaagtgtttcctattcaaacctttaaaaggtgctaaactctcagttaatcttctcaggtttgggagggactggaaggggaaaggtctagatgcagatttttcccctacaaaagatgtctttgcagggccatttcgaaatatggcaaagaaatatactttgggttccttctttatctgtcatatgtttttatgccagaatgagattggcaatgaagcggctacgttgtctggagtaaatactaggggtttgtcctctcatgccaagaaaatttaggacagggacacacacgaggagtttaggagtggaggttaaataggcagaagaaagaaaaaggaggacagccctctctctggtgagagagagggcttccgaaagggaaagaccaccagagtcggatgcgcgcgattttataggcaggcttgagggggctgatttactggggcccacagaatggttggatcaggtgcgccctttacatagagtgcgggaaggctggccaccccaccctaatcttattatgcaaatagactttccactccactggcgccatcttgtctgctccttactgtacatatggctgccaaagagaaaagggaagatggagtcgctgtttggaacatgattggcccagctgctagcatctatatctgcagttcaattttacaaactgctctttgttagaaaatgattttagggctgcttttcattaaaaaggaaaaccttactgaggactcctgtaccctcactgcctaagtaatttcatcttaactcctatatcagcgactaacccacattacacagggttaaataaacccatctaatgagattgtatggtcaatacggcatgataggaacttggacaagagaggaaaaggtccaagtttagtcctcataaggaaattcaaacttttttttttttttgagtcggagtctaactctgttgcccaggctggagtgcagtggcgtgatctcggctcactgcaaactctgcctcccggttcaagggattctcctgcctcagcctctccagtagctgggattacaggcacccgccaccatggccggctaatttttgtatttttactagaaacggagtttcaccatgttggccaggctggtctcgaactcctgacttccagtgatccgcctcagcctcgcggagtgctgtgattacaggcttgatccaccgcgcccgcaaaaacttttttatatataagtacctagaagagaaggagcagaaggagcagtatgaagtttcttattaagatccagcatcgctatataaagaatgggggcattgtatgtttaagtgtgtgattaggaaaaggactttttcacacgttttcaagcctcttctatgttaaaaagctattacgaggaacaccatttcatgcatagatgtatttccctttacagtagaaatctagtccatatgttcagagttgaattcagcaagagcatgtaatattcaaagcaaggcagtgacatttatataaccttttcattttcttttgatgatactttttgaattcaaatcattacttgtagaaatatataagttcaaatatgaataaaggagtaatggaggaaaaaagtgtgttatgtgtgattgcatgcaatgtacattcaggaatatgagtaattgagaataattgtaatcacatgtattatattcatccatgatgaatatttgtgaaaagtaatgtgctagtcttttgtataattttccactgaatgaaaaaggcagataaatgatggaaccatttctcaaattataatgaaatgaataactttagaatgtaaagcatgggaaaaaatgcctgctatctggaactaatgactttatgttgcacaatagggactgtttgtatatcctggaaagtgcagtttttacattacaataaataatatttggggttattgttttataaaatggatttatttaaatgtagaaaagtagtttgggaggcagaacaaggacttttggggaatgtgttgaagatatctaagaacttcctaaagggcgtttatgtttacgtgtgtctcagagacagtcagtgcagctaagcaatgtagaatccaccagcaatagtgtgggcagagggaggaaaccccaaacctgaaacacaaaacaatgaattgcttctccctgaaaaaggaagaatggacgcaggctagaaactagtactggatgtctaaaacaatttgagccctgggaagatttcagatcatccaaaaacagataaaacaggttgcattcaggaagtcagaaatctattatttttatgacaacaatttcagccattgttaatttaggctaaaacagcagtggtcattttaatttaaaatcaaaatcatacacttctttgctatcctctggaatttttgattttctgtttttcatcactttgggaatgggtgagtttgtaaagagagaatctggtgtgtgtgttcaggaaggaggggtgggagctacatgcattcacatccacagttagaactatatcctttactataatacacatgcacacacaaacacacacacacacacgcgtatttatgaaaaactctaaagagtttatgagtttatattgagcttctcagaacttccttaacatggtgaaataaataatacttgttctttctagaaactcctctatatatttgttaatttttccaatatgttttgtgagatttctactttttacatgtgggcttctactctgagattttattcttcacttaggcagtttctcaaacttcagtctttaagtgctgagcctttataacttgaattatgacaataacttacttactttcaatatactctataaaatatcacctgactactgtattggttggcttcaggaatgtttcagctctatctgtcttgaactgtctgggcattctttctctctttgtattccttgaagtttgataacatgggcaaaccatcatcacttcttaccatattgttttaatttttattacttgtctctatatccaaagtagttcagagacaactatttacagtgcctagcaactttcctgtcattttgtttaaaaaaattttgttgaataactggaagaatgaatgaatgaataatttttaaaagagagccacatttgtttctttctgctgaattatccatgggtgtctggtttataccagggagactcttcacaagaattgtggcaaataagcctttgtcccacctctctgatccagccctggataaggacccactgttaaaagagaggtgaagggtcttcctcataaatctcttttattattattattattattattttatactttgagttctgggatacatgtgcagaacatgcaggtttgttacataggtatacacgtgccatggtggtttgctgcacccattaacccgtcatctacgttaggcatttctcctaatgctatccctcccctaacccccaacccccaacaggccctggtgtgtgatgttcccctccctatgtccatgtgttctcattgttcacctcccactcatgagtgagaacatgcagtgtttggtgttctgttcctgcgttatatcattctgtaaccacacagcaggttctccttgcccactgcccagacatagctgatttatgaagacaggggaattgcaatagataaagactttaagtcacataaagctggctgtacaggagatcagagtttcattattactcaaatcagtctccctaaaaattcagggatcaaggtttttaaggataatttggtggggggggggtcaagaaatggggagtgctgattagtcagagatgaaatcatagggtattgaagtgggtttttcttgcagtcttctgttcctgggtgggatcacagaactggttgagccagattacccgtctgagtggtatcagctgttgcatcaaaatgtagggtctgcaaaatgtctgcagcaatgatcttaggttttacatcacaacagtgatataatccccaggagcattttggagaggttcagaatcttgtggcctctggctgcatgactcctaaaccataatttttcatcttgtggctaatttgttagtcctacaaaggcagactagtccctaggcaagaaggtggtttgtttcagaaagggctgttattttttttttttttagcgttacactaaattcactcccaaaattagtttggcctgcacccaggaatgaacaaggacagtttggaggttagaagcaagatggagttgggtaggtcagatccctttcactgttacaataaaggcagtttcaattcctctgagttttccataggaaaagaaaattcctttggtttacatatgtgcttagggttttatgatttcaccataatcataggtacacactgtaatataatcttaccctccagggctaatacaaaagtctaacaggcacaataaaagcagacaataaaattgtctaacagagcaacataatacaagagcccacaaaccaaaataaggttacttttatacattttggtatttatatttcttaagactcccaattaatttaaagttaaaaatgagatgtataaatagcttcatgtgtgaatacctttatctgagttttttcacaatatctactatatatcctaacagtcttggcctatgctcattagccgtttggtaatattgacaaagttggtagagtctatttatgtcttctaaatagatgtgtaaataaaaaatagacatactttgaaatagtgttcaagaatagatttttttttttcacatttgtttagtttgatttctggctgtcttcttaaggatgcaaatactatatagcatcaaatactatagcatcattgatttttaaagccctgtaggctgttaaagcctatggcagttttcacaagtaattgagctgtttcagcttgaaccaatctgattgtcctagcaaatcctttgaagtgaagttatgtaagcaaaaactgctcttcacagaataccacattataaaaagcaacattttcttttcctcttggtcacaggtaaaaagcttaagaactttaagatagactatagtcataatactttctgtatatttgatatgctggctgttttataaatagtggttttcttttgaggggaaggtagatctctagctgtagatcaacaggcatggtgattagaagcagcagtttttatataacacccaggttcttcttcctttacttgatggacactcttgttttgagcagaaacatattaaaattaaatttaaaggatcccaaaacataccttaaaaggtatttgtatgtgacttggaaaaatacattattttttctttggcaatattgtagtttgatctgtattccagttaaacacaaaccacacaattacagaagactccttgaacttactttgaaggttaactccctattcgttaaccttttaaaaatgcttaagaaaaatcaactcaccaaaggcagcctttgttagcagcatttttgcattgttattaaagtttaaagcctatattcatttccatctcttgaaatttctatctatgaaatactagtgtttttgacatgctgatattttgaaaaatacaatatttaataaccagctctttgaatgtggggcctaatttcttctgtaagtcatgaaaatgttccaggctgattttgcaaccacattttgtttccagcaaaatgtgcagtgtgaatatttttgtaataatctaggaatattagctattggttggattaacaggaattcatctgaaaatagtatagcacttctgaaaataaagtacatttgtacccatgagttttgaacttttattttttaatacatgctttttcagcagcagcagcagccatagtatcaatgagggattgtggtatgatgaggagaaaattctaaattattttaaagtgccatgttataataacacataatgcattatttgtgtgatgccctaaaatgctaaatattgaaaataaagaatgacagctatattcatcaactgcttttccttgctacaatcaattaaaacagttttggattctataattctttaaggcattaggtcaacatttattattggtccttttattggtattctatgggtttttatttgtatttttataataaggatactgccatgctctgtcttcagttgttaagtgcttattaagttcttgtttgttactatgtcaagtaggagggactatgaacacttttaaaatgttgtctttgccgttaaagtgtgaactatctacatgagcacatgtaattagtttaaatgaaaaataagattaaatgcttaatacatgggaaacacattttcaagaattaatatgattcttaggtgaactgcttacattttcctagattcctccttctcgcccacagtcttcaaatgaatctccaactcctttcttttccaccttctaattgctctcaaatccattcgtcttcatttccagattcaccttcatccagacaacctactgattatcctaatggggctctgtcctagtctgttttgtgttgctataacagaatatatgatgctgggtaatttataaagataaaaagtttgactcacaattctgcaggctgggaagtccaagatcaggcagcccatctggtgagggccttgtgccacttcaactcatggcagaaggtggaaggggaaatgggtatgtgcaaggagaccaaacatgagaagaaacaactcacttttgaagtaactaatccagtcttgtgagagcaagaactcactccatgagatggctttaatctattcatgagagatccactcccatgacccaaacacctcccactagggcatacctttcaacactgcaacattgggaattgaattcaacataaatttgggcaggaacaaacctcatccaaaccacagcagcctcccttctcaaagcttgcctactcctcttagagcgctgctggaggaccttcccaaaccaaattatcactggtctcttattttcctaacaaccttttaatgacttaacacaaagtcaaaagccatgaacatgccaaaaaggccctgtgagatccagtccttgcccaactttccagtcttttcttgtacactttcttcccaagaattccacatacctgccacgtggaactacattcattgggtctccaagcttaacatgctcccttttaccttgaaggttttctgtatgtctaaaaaagtatttgagtagttaatgaatactgccacctttgcttaaagtaccataatcatccacccctatcaattgggtttgatgtaattccccccagggactccagtggttcctgtaatttccctaatgtagcatttatgcatgtttcaagtatttcttacccccactaaatgatgtgaataaaaggactatatctgttttattgttttttgtttgattttgtctttagagcttactgagctcaaatctattatatttgtactattttataacctacgtcagaggcaaatgaaatatgtaagtcccaatcaccattaccatgtatccttcaaatctttttcttatgcatttacatacatatacagacacatattcatatatataaaaaaacagtattgttgtaactcctttacttctaccttaatattatgtcctgcagtgttttacatactatttgcttagaattattattccattttgtagagaaatagttttatattgcatggatatatcaaaacttatttaatcatgccaatattgataagcagttaggtaggtttcagttgtcccttactacaaaaaagttacagaaaccctcctgtaacaacttctttgtgaacccaagaggatatttctgagggatgtggaagcattaagaatgagagcactggaggcagactacctgggttaattcaaatcctgactctacttaatctctctttacctaatctctgcacttagtttgtttgctataaaatggggattataaaaatacggccttccacataaagttttttgagagttaaatgaaataagatatataaatcacttaagacaatgtctggcaagtatcaaacaattagctgttattattattcatatatattcatagaatattctaagaatatatattcatagaatattctatgaatatatatgaatgacaacacaaagtttacttaaatttattagatcaatggatatgtagatttatattttggtagatattgtcaaaaattcttaacttcttgaagtacttttttatcactctcaccaacaatgcttgagcacttactgtatactatcaacattctagattatcaatctttttgtttttgcatatatatgtgtatagacatatatgtacatatttatttatatttgtatagataattgcacagatatatcgggggtcctgccccgataatcacgtaggttcttttctattttcctaagcgtcgactggcttgagaaataaaaggacagagtacaaaagagagaaattttaaagctgggcgtccaggggagatatcacacataggtaggatccgtgatgccccacaagccacaaaaaccagcaagtttttattagggagtttcaaaaggggagggagtatacgaataggtgtgggtgacagacatcaagtacttaacagggtaatagaatatcacaaggcaagtggagacagggcgagatcacaggaccacaggaccaaagtgaaattaaaattgctaatgaagttttggcaccattgtcattgataacatcttatcaggacacagggttttgagatcaaccagtctgaccaaagtttattaggcgggaatttcctcttcctaataagcctgggagcgctatgggagactggagtttatttcacctctgcaatctcgaccataagagacaggtacgccctgggggggccagttcagagacctacccctaggtgcgcattctctttctcagggacgttccatgctgagaaaaggaattcagcgatatttctcccatttgattttgaaagaagagaaatatggctctgttctgccgggctcaccaggcggtcagagtttaaggttatctctcttattccctgaacaattgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcgcaatccacattcttctgccatggcttcagccggtccctccgtttggggtccctgacttcccgcaacacagataatctgttttttttccccaattgctggtagcaatgaacatcttttgcaattttctaatgacattgggatttcttctgtaaagaaactagtcatcctttttattcgtatgctttgttcattttgccattgaatatttttgccttacttttatctattcatagatcttcatgtattctggtgataaattatttgtctgttatatacattgtcaaggattttctctgaggttattacatgtgtgtggtaatttgatcgatatacaaaaagatattttaaaagaatttaactgttgaagtaaagtctatcttagcctttatggcttttttggtttatacattgttaaaacaatctcccccaagtatagcacattttatgtgccccagaaatatttgttaaatgatttaggcttgagttgaacaaaattgatgttttgcttgtttgtttgatttttagtaaagtcagtggtctctccgggccataaccatgaacagaataccagaatcagatatctttccttatgaaaaggggctttgtttgtatacatggaacaaaaataaaattattagcttgacagttaaaattaaagttttaagtaaatctattaatgtgattatattacagtaattcttgaattgtatcttgaattgtattcatgaaatagaactaataagcagacggtataaatattatttgttgaatattacaaaaatattgaattgaagatgggtagaccattgcatcctcatcaactttgattagcatttcaacaattattttgaataattatgttctcaaaataattttatcataatgaaatctggatagtttccaactatttctaaagtgaatagaacttaagttctagcatatatgtacacatatgtgtatacatacacacacactatatatatatttatgcatatgtatatatatatatacacacacactagaacttaagttctattcactttagaaatagttggaaactatccagatttcatacatatacacactatatatatatatttatacatatatatacactagatatctatatacactatatttatatatgtatatatacacccagtagagatatatatatatatatatatacacacacacacaatatatatataaatacatatatttagatggagtctcactctgacgccaggctggagagcagtggtgtgatctcggctcactacaacctccacctcccgggttcaagcgattctcctgcctcagcctcccaagtagctgggactataggcatgcatcaccatgcccagctaatttttgtatttttagtagagatggagtttcaccatgttggccaggatgatgttgatttcctgacctggtgatctgcccaccttggcctcccaaagtgctgggattacaggtgtgagccatcatgcctggacctagtatatgttgattcacagaataagtactaccttctagggttcagataccatgatcatttatatatcttgcttctgattctccttcaaagaaaacatggatacctctagtctaatcatttttttttgtatatgcaaccaatacaatagtctgaaattttatattaataaattctaccccaattggattggatgggtccttattactttccattaccctaaacctgctgaattagtcaaggtaggaaattacaaaatttttcaaattggtacaaatgatcaagaacacttatgaaaaatgcatggatttttggtcagtagttggctgagtttttgtttgatgtaggagtactacgtctgaattaaatattattcaagtacatacggaggctttattataactcctttcatctttcaacctactcttcagagtacctcagttttactagttaaatctaaggtaactaaaattgaatagcttaaaattatatgagtaattacactaaatttcaattctaatttcttaacaaaattgaagagatcactctgacacttagtagcagtcatttatataatgttattggtgtaggtggttacacattgcagatttcttatctctcatactctcagctaagtcccccaaattagatactctggtggattgcatttgtttggatttatactcattgtcttagtctgattgtgttgctataaaggaatacctgatgatgagtaatttaaaaagaaaaaaggtttatttggctcacagctctgcaggctgtacaagaagcatggcatcagaatctgcctggcttctgataaggggctcaggctgcttccactcacggtggaaggtaaaggggagccagcatgttcagagatcttgtagggaaagaaaggaagcaagagtgagggagatgggaagtgccagtttccttttaacaactagctctcagggaaactaattgagtgagaactcagtcattactgcaaggatggcaccaagccattcatgagggacataccttccttcacttcccattaggcccctacttccaacattggggatcatatttcagtatgaggtttggagtgtcaaatatccaaactatagtactcatctttgcctggattccaatgttgaaacacactcttctttgcctaaattcctatgttatactcattttttggctattttaaatataatttgagttcacatctggaatgacccagctacatatactcttaggaaagtgatgcaagaatggcttaaagaattaagaaacccagtcttttctctaccaaataataatataagatggataaatttctcagatatgctaaattgtccctttaaaatagtcacttataaaaacaaaacaaacaaacaaacataccacaaacttttttacaggacattaaactctcaatgacagattatctcaggaccctaataatttacattcccttggtagccgttcttcctcaggatattaatacaaattatctagaaaataaaaattctatacttattagatatctttatcaactggaattatgagtttgagagcattgcagtaaatcttcaatagggaagaatgctagacaatggatccaagctgggatgaaaagttgcatcagggaggcagggctagggctttaaaaacagaaggggaaacaatttctgaaataagaagtttatttaacaaataagccttctgcctgattttatcagaagcactattaatgtggaattcttgatgcctaaaggctggtgcataactgccttgctatgaaatatctggtgtgaaaggtctacttaagacacatacacacacgtatacatgattcgttaacacatcctcagtgtggtaggtactaattgtatattaattgcctaaaaatgtttatgttttaattacaggaaacattcaccaaaattaaatgattgttatattttacaaattgatttaactggagtttcaaaataatgaaagacttattgttggttacttcagttcagcaagtgaattgtaaattacatataatatttgcacactgaattaagatatattctaagcactcagggacactgataaaatgtatcaaaccggatcacaaggtcaggagttccagaccagactgaccaacatggtcaaaccctatctccactaaaaatacaaaaattagctgggcgtggtggcacaagcctgtaatcccagctactcagaaggctgaggcagtagaatcgcttgaaccctggaggcaggagttgcagtgagctgagatcgcgccactgcactccagcctgggtgacagagtgagattcagtctcaaaaaaattaaaaaaaaatttaaaaatcaaacagttaaatgtttataatttatatcgttgaaaataagataaatgaagttagaatgatactattattattactgaaaggtgttgtgtcagaattgtcattagtaagtgagctgtattatgccattttaactttctaattgttttgttttataaactttgcacattcttagtgtaacatctgtcgttaacaaaaacagagcaatacatttgaaaattgtgatcaactaggaattttgtacaacttaaaaatttagaaaattctgtcattttagcatgatttaattatgttttcaacaaaaattttttattaaaattaaggaatatagattacaagttcctaagttttcaatttttcaaagtgaacacaaaatcaaatataactaaatataaaactagctgtctcagtccattttcttttgctgtaacacaatacccgagagtgggtaaattataaagaaatgaagtttatttagctcagggttatggagattatgggaagtccaaaagcatagtgttggcctctgttgagggccttcttgctgcatcatagcatggcagagggcaagggaatgctcgtcagctcaggtctcttttcttcttcttttgccccaagtcccagtgtgggggtcttaccctgatgactttatctaatcatagttacctcccaaaggcccccctccaatcagcatataaatttgtggattaattttccaacacatgaaatttgggtgacacatttaacacattcagcctttgcctatgttatataaacaacagtgaaaggaatggagctttgacttgaaaatacaggtgggccaggtgcggtggctgatgcctgtaatcccagcactttgggaggccaaggcaggcagatcacttgaggtcaggaattcaagagcagcctggccaacatggtgaaaccccgactctactaaaaatacaaaagttagctgggcgtggtggtatgcacctgtagtcccagctactcaggaggctgaggcaggagaatctcttgaacctgggaggcagaggttgcagtaagctgagactgtgccactgtactccagcgtgagtgacaaagcgagacatctcaaaaaaaaaaaaaaaagaagaatggtgtagggtttttactaaaaggagctcttatgaggaagagcttagacatttgtacagattgagaagataagaaaatagatacaattttaaattctagatcaataagctttccagaaaatgttgtatttggaattgatttttagtgaagtaagctacaaattgagtaatatctagaaatattcaaaggctagatgttaatcttttagcgatgttctagtgagaattgaataagaagctggatttgatttcttatccaaactttctaactctaaaattctaccatcatagaaacttatatatcaatgaataaaatcacattatattttttctaatagactatattaaaatggaaagaaaatggatttcgactcagcacgagaatcttctaataaaaagcttttcaaccatgggacaggaatctttgaaagaaggcagctatacatccctgtttccctgggactcctggtttatgcttgtttctggagataatgatatatagctcctccattcactcaccacagtgtcctgatttttgaacaataaattacatagtcattctacttataaggcattgagcacactgaccctggaggtaactctctctagaatggactaagtggactgtcaaggataacaatcattctgacattgaacaggacatagactcttattcatccagattcttgtcctaccaaaatctaaaaaaaaaaaaaattatataagtcatttaggcttttgcagactatcagtttgtagataactgctctacctcaataaatttcttgatacacaagacaaatgcctttctttaaaatactacccaaaaagaggtaattaattaaaaatacgctatctctttggagataaaattatatcactgagttttgaaatttttttggaaatgtatttgctctcattttcttattaatttgtgtgattgattatccctggctttatgataataagaagtcaagttctaaatggaatactaatatttctaagtttaaagtttgtgatacctcaaagtatctgcaaacatttctacaggaatttaaatattccaaaacgccttaaaaaacttaatgaatattacaatgcaatttagttcatgatataccattagaaagaaggaaggagtgatgaattagtaatttcacagattaaaccacaggatgtggtagcttaaagaaatttagaaattattagattagtctgggtgcagtggttcacgcctgtaatcccagcactttgggaggctgaggcaagtgcatcacctgaggtcaggagttcgagactaacctggccaacatagtaaaaccccatctctactaaaatacaaaaattagccaggcatggtggcatacgcctgtaatcccagctacttgggaagctgaggcaggagaattgcttgaacccaggaggcagaggttgaagtgagccaagattgcaccattccactccagcctggatgacagaatgaaactccatttcaaaaaaaaaaaaaaaatcgttagattaaaatatgatctgaaaaacagaaaacggccaagattagttgtttcagttattcatggaatcacccaatggttaaacatggttgtacatgcctctacattttgtctgtattttaagtatacacacgcgcgcgcacacacacgcacacacatatatatacaaatatatatacacacatatgtatacagagagcatatgataatcatccaatgaactggtaagtaaagactaattgaatattcattgtactggtaaagttcaaaatgaaggctaaatagagctatttcttttcaccacagtttttgtttacttaagtgcaagtgaggtacattaagaaaataaaaactcaacggaaaccacacataacccacgttaattgtttatatttaaacttatctgtgtaaagtatggggaaattaagaaaatagaataggaatctgagaagttaaaagtacataaaataaatgtatgcggacatttgaacaacaggagcttttgtttcacatttaaaagcatagggaaaatgaatactaatacataattcaaacaaatgagtatacaaattactgaacaattctatagtgaatgttactggaagaattggctagcattccttttgatcaatccttaatataggccaagtgtagtggcttacgcctgtaatcccagcattttgggaggccgaggtgggtggatcacttgaggtcatcagtaaaagaccagcctgggcaacgtggtgaaaccccatctctactaaacataaaaaattagctgggcatggtggtatgtgcctgtaatcccagctacttgggaagctgaggcaggagaatcgcttgaacccaggaggcagaagtcgcagtgagccgagatcacaccactgcactccagcctgggtgacaaagcaagactctgaaaaaaaaaaaaagaaaaatatttcttaataatgtgatcccattttaactgaaatgttgctttgatgatactttattctaaaaatatcagttaaattgagcattagttgaacaataagcattatatcgaactagaaatattactcttttcattcagtaacatattttgatttattttgtttgtagtagttattttttcatcatttttatatacagtaatttaaactttcacttcataaaaaatgtaatcttatttgacttcttagttatagcagacataaaagaaaaactagaaacactaagtgctgacatatatatacatatccctatatattatgtatattatgcatatatatatccctcatatatcatgagtcctaattttgagtaacttatgtaataacagactattatttctatggatactgtggatctgactcttaaaaaatggacatttttaagggtagctatttaccaagatgaggtttttctctgccaaatgattaagtgtacaatcagaacatatttatcctttaaagttaaagttaatggcttaccaatctagaatctgcacctttaacaatgaaaatataatttcttcattgtcaagggagaataaggaaacttggaagtcagtattaaagagcaaaagaaccacctcctaagacattacatttactaagttctattttcttccattatgctttcccatgtttagagtccttatgtattattaacatggaagtaaacagagaaagtaagcaattaattgatgggcttcttatcagccttctgagtataaattcagtagggatgttgcccagaaatgtttatttttgttaggggctacattgtgctcacagaagtctttttttccactgctgtcagtaaagtagtaaagggtggtggctgtgtgggaaaaatttccaatgcatgatgtacatgaacaatagcataaaagttgtgttttattgtagagtcactgatgtcctccatgactgaccttctccattctcacagtcccaggccttcttaatcatctttcagggatcactctagcctgccttacgcatggaccagaaaggctgaagaaggctctttcttttttctactttcagatgccatcttattctggtattgacagccagatctttctctgtataaacctaatcatccaaaatgctaattgacaatgaactttatcccaaatcagactcctagggacagtaacattgaaaagatcttcttttcaccttgtagtaacttttccaataagaattacttgatattcagattttttattttctctggtatttattggcctcattctggaaaatcctcaaatataggtgggaaaggcaatacacaggaaccatcttgggaaatgtgttagcaactggcatcacaagggtactttgctgagttgcccaggaaaatggaaagatgagaggggatacaaggatctgcagtaggcagttaagggaaagtagaacagggaggagtagaggtacaggaggaaaaaaagaccatggtgttgtaattcaggggtcagcctggctacatcatgatggacactaaaactagatgaactaagatttggaacaatagtagctgtctttcacaggtggagctttggtcatgtgactcatggtctttctttctcctatcctataatctttgtcaagtgatccctatattcccgtagctgctttcaatgaattgcattctaccatcttttaaaaatgcaatttatttgaatataaccaataactgctattccttttcatccctttgtctgtaaattaagactttaacagaaaaaaaatttaacttttttgatcaagcatgtattaatacagaaataaagtcataattcaatactagcaatgtaaccttgggcaaattacctaatatctttacactctagtttctacctctgcaaagtagggattttaatatttaccacagagaacatttgtgagtattaatgaaataaagtatgtaaagatattgaaactgtatctgagacacactaaagacttactgaattgtaaataatatattaaaaatatctggagaaaataaggaagcactggctaaggatcaaatatttgatatatgtgtgtatatcgtattatgtttaaaagccattatttaaaatgtcattaagtaacatatatgttacatttttgtgcataataaaatgacacattcatttatataagcatatatttctggatttctttaaggtgatgtttcttaacctggggcagggataacaaactgaaaatctgataaagtctgtgaaattattcctaggtatatacatatttgcccaacttgatttacacaaatttggcattcatggaagctttggttcccatttatggaattcacaggagtctaagaccaaaggcctaggattctaaaggcaagaaagtaacttggaaattttgagtttgagtttactttctaaaatatgtacttttttttttttttttttttttttttttttggtattctgggatactgacctaacctcacaggcattaaatattttcatttaaattggcagttgtaaaggattatttctaattccaacttcaccttctatattcttatgaaataactagcttctccaatccttttgaaatacaagaccattttctcccacttgatcatgctggtatgagtgggatgatttagcagcactcactaaagaggtgcatcttcctctgactctggccttttaaactgggacatggcactaggagcaagagccaaaagtagaaaagacaagaggcttgctcacagagactaaaaggacaattgaataaggatgtaactgtaaactacatatcagtggcagccttggtttgaaggcgtctgactcagagtgggaaacagcttttaagtgtgttaatatcattttgtttatatttgacttttagtcctttgtatttttaatccctgactctgtcttcaaaactagtggtagtcaggttgtgttgtttgtcttggttctagttttctcttactatataacaaattaccccaaaacttagtggcttaaaataacattttattatatggcaggattctgtgggtaaggagcttaggctggactcgactggatgatttctctcccgaagccattgactaaagtccctcagtggtattcagctggcaaatgggctgttctgcaggatccaagatggctttacttacatgtctggcattttgatgtgacggctggaagacttggctgacctagaatggtcaactgaaatgtttatctgtgacttctccagaatagtaatctcggggtactcagataactttaaaggaacctggcttcccctagagcaaatgtttcaaggggcctacacaggagcacaagaattcttttgagctcatctcagaaattctaaaatgactcagattcaaggagatggattataaacgccatgtttcaaaggaaggagtagcagctgagcataatgacttctgcctgtcatcctagatacttgagaggctgaggcaggaggattcccggagctcaggagcttgaggctacagtgagctgtaattgtgccattgcacctcactgcctagtgagatcctgtctttaaaaaataaaaaaggagaggagtagcaaagtatttgtgtccatctttaacctaccacagtttttccccctaaactttgagtaaagagggttgagttctcagtttattgcacattaacattttggtccctaaatagcttatttatttgtttgctttatcccccattatagacaactattgcattttgtttaatatgtatattttatttgaatgttttactgaaaaatgtgtattgtttggggttgatttattttggattagcatgaatggcattgagttatgtatcttactactcttctttttatcatacaactttacgtggttaaaattaattccttgtttctaagtgtgcatctttgtgttgcaaagtcctcagtagtgggaatccactgcattttaactattcacccttccagtgatagttacccagagtatctccaacttcctgttaccattagtttcaacaaataacatcaataattgtctgtgttcaggcactattctaggtaaaagcagcatacgtattcttatggacatatgtccataagaatggggaaggaggatttctttctatgagcaaaagttctgagtcatagaagtttgtcagacggttttgcagcatcccagcaagtattatctcccaggtgccaattaactttgtccatggtgtttattttattaaacaagattcattttaaaaaattttaaatacccatcctattttggatatataatacattcacatgattccaaagtaaaaacaatatagcaaggtcaacatttagaaatcttagtcccatcctatctctacctactccactcttttcccacaccttgtattcatttcttctctattgttccaatgagaattcctcgattttgttgaaattgatttttttttgtcttttggtttatgctcttgaattttttttagaacatatttttagggtttttaaattattttaacattttggttcttcgtctttttattattttattgtctttaatagtctcaattaagtcttgtttctaataattttaaaattacatgcaaagggtataattttgttttattattttttactagataaaatctcaactttgtccactggaggatattcagcaatacaacatgtgatgatttcgtatatttatattgtgatatatttaacttactaattttgagaagcttcttgtgaattagttggcaaatgctacctccacatcttttatgaagctttggtccatggggatagggtaggttgatttgcatgaggagtccatggttttcctgaaaagaaggaatcatttctctccaagtttcaggtttaaagtgttaaattagggtagctacaaggaaagtaggttgcagagaaaatagggagaaccagtgagccagtcttgcctctaaatcagaaaagtggaaatagaaagagtggtcctggtgcacagagcaaaagatgaggtcactgattataactgagagcctccaggaccagatgctcaccggcaggagtgtggttgcttggcaccagccagtgagtctatttataataggtggaaattcttctgcctcaccacagtggtctggagatggtcctgagaagctccagaagtagtatgtgtttttcagtgaagagacgcaaccttatttgtaagatgtctcaccctgttaataagtttgccttgttttcttttgtttgttcatgggagacccagccttcattcttccctgagctctgcatgcagtggcactgtttcactgtagctggaatctctatcatctcatctccatgaggccaaaccttggggcatcctagttccctgtgtgagtggctcagtgagaaagtaaaaaaaaaaaatgcttcatattagagagccggggccagtttgaacaggaacatccttatccctgaacctaaacctatgcctaaaaaatgatgaggccctcctcacaggagaggaaaataccacctgttttcatggtcatcccaaacagaaaactttgcttctgttctcaatgtgaaatgattattcaaagccatcttaagctctgttaccagaattctccaccacttccacattaaaggaactagatcgggttcctccagattaaggccctcaaatacactagaatatgttaaggtaaatgaggtgaggccttggaatggcatagatcttgctactactgctactggggtactacaatctcggaactgagttatatcatttgtacttgtactttttacttatattaatcatgtgtccccctaattataggtatttagatttttcttttaaccttttttctttttttaaattttaattattgtggatacataataattgtatactttgatggggtacgtgtgatgctttagtatagtcatataatgtatgtcacaaacaagagtaattgaggcatccatcacctcatgcattgtaactcatttttaaaactagatacttttatttaattatatataatcaagcatgtatttcattttttaattttactctttcaatatggtatataactagcttaggcatatagagatcagctgtgagggtaactcattcactaattctgggttctcacattagcaaaatgagcaccacttgggaacttattagacccacactccgagggcggggcccaggaagctgtgtttaataagcccaccaggtgattctacatgctctaaatttggagaaccactgtgctcatccccttgtattcagtatgtgttgtcatcatctgtgcttattagtcaggcacagtctaaggccccattccaggcccacagcatcagaatctgcattttaacaagatctctggtgattcttgtggacagttgagaaaaactagtctgataaaaattgcttgttctcatttttatctgctctggttggccctgtctggtgttgcccttctggcctctgtaataaatgcacaggtttttccaacattgaatcctttaattctaaaatcactgagcttcaaaatatgattactttatatagaaggggatttctgcaaaaaaaaaaaaaaaatacaagttaaatctgaatgtcagatcaacaataaataatattttaatgtatatatgtttcatgtgacatttgatacttggaacatagttgtacaaataaattattacttgttgatgtgaaatccaaatttaactgggaattctgtatttttatttgctacatctggaaattctacatatatatattaattatctcctaggagaaccagtaatttctgccaacatcaatatgaatatttgctaaaacagccctgtcttgttacataacaatttttccgttcctttggaaaaaaatggaatctgaaattctgatctctacttctaataagccagaatctatatccctttttatacttacaaaagataaaatcgagcttagccttattatcttaaataagaactgacctaagaatcaaaatagtctgctatctgaagctagtaagagggaaggacaaaaacaaaaatcatttttgagaagcattgtctaacacataaaaattagtatcaactaattctctgcagtaagttaaatttttcaggtgttgaggtcacattttacaactaagtcattttggttcgtccatcaggagttcctatggatgcaaatttgatactttctgctggattatttcttagaggtctgatatggttaggctttgtctccccaacccagatctcatcttgaattgaaatccctataatccccacaggtcaaggaagggaccaggtggaggtaattgaatcatggggcagtttcccccatgctgttctcactatcactatcccataatagtgagtgagatctcacgagatctgacggttttataaggggctcttcctccttcgttcctttgttcggcatttctccttcctgtcgccttgtgaaggtcgcctttgccttccaccatggttgaaagtttcctgaggtgtgcccagaatgctgaactgtgagtcaactaaacctccctcctttgcaaatacccagtctcaggtagttatttatagtagtatggaaacagactaatataaggtccctctggtcttggaggttaactggtaacacctgttctgacttattgtttttaagttaaaattgtctgctatgatccaagttggggatttgcaggttaacacaggtttggtgacagaggggaactaattcacttccctaaagaaacctcttgttggtcatccttgggcccaactctatgtagatatgaagtgcacttttatttggatggagtactctttaattttaataatacattctgaagcctgtcctgcttatctggtttccagaacttacataagtgaccttaatcaacaatatcacattactgcaatttaaactcttacacaggaatactactgatacatgctttgtattttctaccaaaagtcttacagaagacaatttaagggatacactgctaacaatgtactcctgtacatttaaagacaatcattggatcaaattagaataccagagagctgtaaatttgatattaccttggaagaatcttcctttctaaattagctttttaagttttcccttcaaattttatcaattgtcatacaagatataatttcatacattttgattttcactttatattttgttaacctcactctcctattttatacacttgtatttgttatatttttaaaaggagcatagtatatagcacttctgtttttttattataaaaacattgatatgataaaatgcagtttaaagaattacacgaaaatgaatatctttgtccccagcatgctgttttaaaaactaggtactgattgtaccttaaaagcaccttttctgcatcttaattgtatcatgttgatcatcctgctgctagggttaagtgctatcttgaagattgtaataaactttcttttgctttctttccttattgagtttatcacacatatgtttgcttgcttttgatcttttatataactggactttatattgcactgagatttattttttgctcaacattgtttttgatactcatccacactgattcattttcactggcatataatgttctatggtgttacggtatcataatttatttttccctgctgccaattatggatatttgcattgtctcaaactatatgttattgtaaatgatgctgctgtgatcattatttttcatgttttctggtgcatagctaccagagattctctggggcttggtactgaaagtgtgcggtccagggactagcaacatcagcatcacctggatcttgttaaaaaatgctccaccctacatctactgaatcaaaatctgtatttcaaccaatcattccacggcatatacctacaggtagaattgctgaacatgtttgatttcacaagataatgcccagtgtttttctaaagttgtgccaacattacaacccacaaagtcctccttgctccaacattttctcccacagtggcattctcaggctttaaaagtgtaatgtgaaaatgagaagatgatcttgttaaaaatgtttgtatcaattctgtctgtaaatgcaattgatgtgcttctgtgcagccatcttgttcatgacattaagcatcaattatttttcagaccatcaatatttcttcctcttaaaagactgctcacaatttcgttcatgttttatttgtattttatcttttccttattgaccttaaggtattctatatactttgtactactactttgttggcttatagatgttgaaagtgtttttacccagtttgtggtttgcaatttggttccttttttctttttgttgagatgaatctagctctgtcacccaggctagagtgcaatggcgcaatctcggctcactacaacctctgcctccctggttcaagagattctcctgcctccacctcccaagtagttgggactacaggtgcttgccacaatgccaggctaatttttgtattagtagagacagggtttcaccatattggtcaggctggtcttgaactcctgacctcaggtgatctacccgcctcggcctcccaaagtgctgggattacaggcgtaagccaccatgcccagcctgaaattttattctttatgatgttgttgattaaagttatttttaaaacatagtcaaatttatcagttttttacgtggttatcagtgttttgtgctttgcttttgccagttcggtttctctggacatctagttttacacattttggaaacagaagacatggtgaatttcttatactgcaacccacttcatatcccagcagctatagttgggatgtttgtcccctcaaacttcatcttgaaatttgatcccagtgttggaggtagagcctaatgggaggtgtttgggtcatgggggtgtatccctcatgaatggatgaaatgtccttcctaggggaggggtgtgagtgagttctcactctgttagttcctgagagagctggttgttaaaaaaaagccctggcaccacacctctgcctctttccttctttctctctctcctgtgatctctgtgcagaatggctccctttcaccttctgccatggttgaaaacagcctgaggccctcaccagaaatagattctggtgtaatgccttcctacagcccacagaaccatgagccaagtaaacctcttttctttgtaaattacctggcctcaggtatttctttataaaaatattaaatagactaagacatcagccaattagttcccagtagaagtactatacacacaaggaaataatagccaaatgggaaatatcaccttatggtagccaggcagatgatatgcacccatcctcaaagcaaggagacacaatctcatctaggaacccaggctagtaaattttaaaaatgcattttaaatacagagagaatgaccagcacatgttttctaaccacaagggagcagcaagtggtggaggggctaaagcctctattcctgattgtcgagtccaggaaatccattcgttagtataacaccctcaatgaatgtttgggaactgagaccagtcaaatttgcagtgccttcttccacagccagggaacgagagaaccacaaaggcaatgaaacaaatataagtgttctcatgttcctttacctgttggccaaagctaaatatggtaagacagacagatagtaatcaccttgctccctaatttatatacagctgatttctcttttctctcttaactgacgaggctgtgtggttaactaagagaagcttctctgattcccagcttgataatgctcctcccctgctccttctgattatccagggaccagtgatttggccattcagcacttgcttccagaaatctctgaaacagatcttaataggatattaacatttcactcagaccacgctacaccatggatcaaaaattcatagttctaaacccaagtttacagtgggttccattatgctgtctaatatagtgaacctgaaactgcaccagttcaaataacaaaatgaataatgttctaaatttaaacaacataacccttcctcacattaataagtttctactgactgttctaaaattccctttgatatcatgtaaattcaaaggaattgtagtacaacttaattttcattcacaatttatgatttccctagtctcagctggaagagtgataaggacaaaagatataggagtaaacttgaagtaattaatatgcctggacactgttttgtatgtttataaacattatgaggactttaaaacttacagctcattatacatattccctttataatatcccctttaaaatattgtgccatattattaaaatgctatgcaaaataaaaatttaatcaaggcagtggctatacatgagataaaagtaatacaagctttagagaagggggaaatatgtggcaacaagctgaaaagattatcgtctgaaataatctccactaaaaaaaatctattcagtaactacatttttttttaactgttcccctatgtctattaaaagcactcttcattgcaagtaacaagctgcctggtttggagtgtggtagaattatagctcactgcaacctccaactcctgagctcaagccatcttcccacctcagcctctccagtagctggcatcacaggtatatgccaccatgcccacacaattttttttttttaaaatgtagagactgggtctcgccatgttgctcaggctggtctcaaactcttagccacaagttctaccttagccttccaaagtgctaggatgacaggtgtgaggcactgtgcctgtcatgaaattttcatgaaaataaatttctggggagttagttcagaagaaggtaaagctatctaattttgacaaggtaatgttaatatactattttatgtagttttgatatgtgagtttattaataaccaggatacattacatgtgggcatctgtctcagagtagtgagtactaattttaaatgactttttaaacttttttttttcttcacaaccccatatatctagctcttggaataagctgatagccacttcttgctacagaaatagaaaactgtaaatgtgttatttgtgaaagacacaagagctctggaagcaaatgcccaaggcagtctttattaaggaataaattcatttgactggtttgaataatttgaatagcaatgtgctgtctccacgtgatctatttcaggctttaatgctgttgtactgggttgaataatttacagaaaacatttgaagctattagctctggcattcaaaataccatgcttctcatacatggatagcaatccagacacacttagcctctgtatctttatatacccttatgaccttgtcttttatctcaaaaaagtaaaaaggaaaaactggaggagaaaagaattgaggttgtccttgagtacatgtgttttataagagacagagagattgtgttttctacctctgctgagcctaaaaataacaaacataaatgctgaccttgaggccagaatgttcaaagcttggtttttacaagagttccctagttttgataaattcttgaatctcagtgagtctcctcagcaacatctgtaaaatgggaactgattctgccccttgctatcccacaaaaaaaaattgagtatctaaccaggtaagatgttaaaaagacatgatgggtggtctataaagccctcctgcatggtttaaaatgaaattaaaaaaataatattctttatgggacccatttgtctacacactgaatgctgaaaccacaagttgaggaacctctttataagacacctacctcttctagtttttcacccagcaacaaatctctccagaacatgaatctgtcttccggctatgtgagctggttgccctgtttacaaacttgccagtagctgtggccagtgcctcctctttcccagagaaatgttactgattgagcaaagttatgaaatgatatttaactcaatcctaaaggcaaatgctgaaaagccatcagttttcttatgtgataaaagcaaatgaatgaagaataagaaatctatcttctcatgtacatattttcactactttcagttatctgaatgttttgtcgtagaaacacaaaaaacccataggtgtatgcctcttggaagcttccctacacatcatatctccttttcctaatttttcctaagtagaattaatcacttcattctcagtgtttctggagaatgcttctgtagagttaccttggttttcaaatgtcacatggctttagaatgaccttttgatgagcctaccttccccccaattaaggaatgatttctaggagccccatctttttctttctgtattgccaggacctccttagccctgcacctgtgactcagtagagcctaaggacacctagaggttagaaaataaatacaagaattttcagtgattatcactgatattggagttatagttgtattcgaaactatatataaatgtatacatatatgtaaaaaatacataaatgtttttctaagtagagacatgttttataaaagaaatatgaattattaaaatagttaaatattttattgattatacaaagtgattctgtagccagagattctagtcctgcgttaaagaacatgtataactcttttatctagaaagctttattctttgaaagtaggaaactcaattacattattgggtttgaaataatgatgtttctcattcgccatttgttgaacaaaataattgatgaaagcaaaaacaaattgcacatcttcaattgtgtaaaacattttcaatgacttgtctttcccctattttatattaatttttaattcacttgaaatagcaatgaattctttatacctgtttataaaaatggtgaaaatgtttcaaaatatcagttgggcaatgactaatagcaattataaatgcacagctcttgctattgtaaagggagttggcagcttatccctcctcctagacaaattaaaatgatgactatttctccctgttaagagaaaatgtagtagttctactaaatctgcaagtggcagctcgtgcttcatttgagactaggcttttgtttttaacaaatgaaaataatccagtgtctttgcttggatactaatcgtggaagataatgtcaaactggcctatttctacaattgtcgtaacttgcaaagcttcacagacagctgagttcattatgttgaagttgtcaatcacacaggcagtcgtttatattccttttgaactctgttatgttacctcatggatgactttttttctcttctcttttatatgatgttaaaacattccattctatctcctttacaattgacattctagaaaatacccataagattttctttgccttaacagagaaatacaatactttgttcattcaactaatgttagagatatgattccttaggctaatctcaaacttttgaaatcccattttactattacattgagaatttctttctacctgccttattaaaaactataggatgcaatagcattcgacaccctgtaaattcattataaattcacatagcattcaccaagataactcatttatatctatgaaatcaatagacagcctttaaactaaactggaactgaaagtattatcaatactacagaaatttttaagctgtaaatatgatggagagagcaatgttgaatagctgatgtgggtttttagttctgatcatctaacctccactacatcaaaacagttttgtggggtccccatttcagacaaaggcagtaaccacttatttgcttgcatcagaaaacttgccatcattcttctcagttacaaactttctagcaatcactacagtttgttgtttctaacgccagaatattcctggactttgtgtatatctctccgttctcactacataggtttgggcaatcaacattgatacttggtttattataatacaccttgcatcctccaatcttctctccactccaattccttttccatgtaacagccagagtgattcattttccacctgtttccttaattcacacccagttgccctttgagataaatttcaggctgctgcttaactcttccagtgatattaaatttctcatttttggttcctagacagcatcatactcttaattctctgcagggacaaactgtgatccttctggcagaaaaactacattttcccactagtcttcttttaccctagctaacttatgctcagcataaaagtctcttcactcagaaaaactattatgagctcctacaagtattttcagaagacttcctatatgttctcttgtacattttcattctacaccctacttttcaactgcatcctaattgtttatttacttgtctttatttacttctatgtggtagcattaaagaagatttggggtataatattttcttcaactgttgaagaaaaaaaagacgagtcacgatttgacagcaaaaggcattattaatatacatttcatcataactcgaatttattgacaaatgagcagaactatctaattttcttccagctcaggactttcaactccttagccctatccaagtatctaaaataatgtcattattacaaaggcattgcagttcttttatattgttccaaatgtgttttctccccttttcagggggtggggaattttctgctttctggacaaataaaatccacttttctctcacaatcaagtttcctgttgtataggtgagttattacactgccaaaacaccaaggatattaaatacaatagactcctgggacccttctctgtaatggccctttgttgttcttctaggtagaggaaaaaacaacgtatatacattgaacattttttgttagaagttatatttatgcttcattaattataacgcgtaatattatagggattaatcaaaattatttatccaaaccctcattactaggattctcggttatgtaaatctgttataaacagcataacaatgaatatttttaaagtaaatgtttgcccattcttaacatgtaaattactagaagttaaactgctggaataagtaacaaatataaccaaaagaagcaagtttcctcttgatttggcaactttatctcttatatttccactaagtctaaatttatgtattttttttagtgtttacaccttaggtatttacttggtactttgttagaaatcttttaggaattcaaaggtgactaatatataaaaatgcatatacctattaggattagtgacaaatacagaataccaaaagactgaatccacgtgaattgtggattagagaaataatccagtgtcatccacatataaaatttcctagcacacctacaagtctagttgattaaataagctccttgctttgtttgggattaaaagaacagactgtgtggggcaatccaaatggttaatggtagagatattttaaataatcattgcagtttatgaagaccagagccacagactgtctggtcttttgaaagtggtcctagcctaacctactcagtgatcatcaggaataccacaggcctttcccaatccagagaattagaaaccatgcccatcagtgaggactactgcattcacgtcagagatattcttggcttccagctcattcatgagaccacaggggccaatttaaatttcaaatcatcaatagggctcatttcatttagaatctcctatgaagcatggaaagaaatgcaaagttactgtgttggcaaagcattttatttaaagtatggttatatttaaataatccttttataatttaattttgaattcagaaatcctggaaaatgtccattaagcaaataataaaaccacaggtcttttttactataattataaaattagtttcacaaaggtcaaatttattttcttagtaaaagccctttgtagtaatagtaattataacttggaatttgattgtggttgtttaaagttttaatgtcctaatgcttattaaggaaatctacagtgaaattactactagttaacttagcactctctctgcagtgggacttcttgactacaaggtccttttggtacacaactgggtaaaccactgagataagaatcctaatttgttcagaatattagacttttttctggttcaattttttgaataatatctaagcagaagttattataatcagagtaacttttcaaatataccatctccaattattaatataatttttaaattgttaaattatttctctataaaaaaatatacatgtatgcctgttaaaataggcctgatatggctggcagtttctggtaaagtgccaggccccacataacaggtattccaagttagaggcaaggtttaaattgaaatgcttagttaataatttgtaaaatggaatatagtgatgcaggctcatgttagttcaatatgaagagacattgtaataccacaccaagtaaacttaaaatgtggtcttactgattacagagtaatatatgttcactgtagaaacctttctaaaaagtacttatgaatgataattgctttattggtaaattatgatgaggaaggaacaggattaagtgaagcttttagctatatttcaaatattttattttttaaaaagacagaaaactctgaagctaatatgttaaaataattgactttgttacatctagatcatgggtatatagtttaatttctccatttttgaaatgttttaaaatttaaaataaaatattttaaaacccataagcataccacatagtgataattattaacattttagtgcttagcatttcagcttttgttgtatgaatatttaaatgtacattttgttataaatatggaattataattgttaaatatttttgagcaatgtattttacatttttccataggccatatacagtaaatattaattgcccaagtcaaaataaaaatataaacacaaatctaaatttaacattcttttgggaagaaagaattgcaattttatgcatacataaagaccaggtggtctttatgtctgaagaacaagagaaaattgggggtattataaaaaagaatgttgtcggtggttggagagaaagctcatttatattagtaaagctttggggaactggcaagcttaactggtgggtgatggcagcaagcaaaattagttcctagacttgcagcaagttatctcagtagttatagataaaactggtctcaggttataacaggcagtttcagcagccagacttgcagagaatttcttttctagagcaatgctgtgtgccctgagtaccttgtccccctggcctctagactctgatttagttgagtatgataaaaataatccaatttgcatgatcaactttcacataatatatttttaacagcacactattccattaggcattttagctagctttttaaaagtagaagctgagttaattcctgcaatattggtttaagtattaccaaagtgttctacagtgtttgtaccaaattaaatacagaataaccaatttaaaatcttagtcaactttataggtgaaaagtctttcattgttttttttccctacttttttttccaatatgtggagttgtttcattgccagcgttttgaatagaaacactttcattgaggaattatgttttaaggctacctaagatttgtttcaattagggatggccagataggcagacatggaaattactatcttgaaggaggagttttactgtactcacagattcctggaaacaggaggcatgacacaccatgcagggccacatgaggcagccccacggtcagtcaggaggcagagggaggtggtaaaatgtgggcaagagcccctattgtggtttccatgagaagaaatgagcaatgaccaggtttaggatcagctagtttgaataatttccgtaggcataaggatagttcctagttgtctggtaccagggcctgggaaatttaggtctggtggataatggcctggaatttgagagccctatagagaagggtagttaaggtgtgggctctgtcatggttgctttgcatttgaaaggcaggctccctcatgagttgtctactatatctaggaattgactaacaagggtctgcagggccttatacctcaaattatcagaacatagaaaatagaaaaacatggttaatgcaaattggttttaaatatgatatttctaaatcctgagcagaggtgcataatgcactttggagaaaagaaattagaccaaagacaatacggttgtaaaaattctttattaactcattaggcaaatgtttaccaagcatctactacatattaggcattcaatcatgggcaaaatcagatccgcatcctgctcttacactctgaatttcattttcaaatacattatactggtgtggatttctcatagtttctattaaaatatttcaaaaccaagagtaactaatatgcagttggtatatctatcattatcttctgtcttctacataggatggtttctccagactttcaggtttcccttagtcttaactgtaataatactgttgtatcattggttgtttctaatttggaggaactttggataagtaacaaatttttctttcagtgactcaaaaaaatagtgggtgtactttaggttagaattaaccctgtgatgtgctttagtacttgccaccctctgttaataagaactgtgttggccaaatgtgatatttgaagtatactcgttatttggaaggaaattgctggaattttaaaatgtagttcttatagagacatgtttgattggaaataattaaatgaacataaggaatagcatttgctgtgaagttttacaaagagttttaatattgaattgtgctcagttcacacacggaaatgggtgtctactttagtgacaatggatagtaaatgattaggtttttttcaattatttaaattctgatttccaaggaatcatttgaacagcttttagtagtaaaaaactttattttgataatcaattttggttcctgagctttctctctctgtatatgacagattttctcaaattgatggcttattttgcagtgagtggctggaaaggattttatgttcaaactgctagaggtttatcagcaggtgaaatatactgtcagttgcaatgcatgttttgtaaatatatattttatgttttctaccacagaggtattttgcaggtgtattaggtcatattacacaaactgatttttaaaaatgtctattctaattctgtcttcaaaatggtagaatggaaagaatcacaatgttgtatatggctttcaaataatagactctgacatttcctaagacagccaggcatagtattatttccattggctgtgcagatctctattgctccaactctctaacttggtcaaaatatgtttccctcattctttatgttctacttgcatcttccttaatcctcttttctcatccttcttcatttatttacttatttaccttttagagacaagatctcactatgttacgcagagggcctaggactcttgagctcaaatgatcatcccacttcagcctttcctgtagctgggaactacaggtgcatgccactgtgcctggccctcctcattgataaaacatacatatattctccaaatgcaatgcaggaaaattgtttggctcttaatgtcacttcacactgagttttcttgatgatgacttcaatttaataaaatgtttttttgattcatttctttattattccgtgtgttgcctgatataatatattgctgttgatggtaaaaaggaatttttctaagtctcttcttccttttcttccatagctgaagaaaaatcattataccatcatcctaaatttagattcagaactagtcccacattaaattcatatgacaaagtccatgggacaaaaataaatatgtaaatgtaattgagttattgcctaacctaaaaagattagtgtaaaaatacatagtatcctcccttggtaatgatctaatattgaacaactaatagtttaccaaatatccttaacacgtttataagattttatccttccaataatagttaagttaggcagtcacagatatctttgttctttgtgtgtatgagtgtgtgtgtgtgtgtgtgtgtgccagtgcgctgcgcacgcctgtatgtgtgtgtagtatgtgcatgtatgtgtacatttatgcatatattcatatataatacatagatattttattcataaagataaaatttcaagtcatagacttttgaactgacccaagaaggcacacatataaagtaacatatcaagggctagaactcaacatttgtgtatcttgatttaaagtctgcactagctttttttcctttctaataaaatatacaggcatgtacaaaggaaaaaaataaagatcacccacaatgcctgtatgaaaaggtgttcacttacccagcaaatatattttaaattcctactatgccactttgctactagagagagccatagtgaaacaggtttaaaaaaatctatgctcttgtatagagttcacattctagtggcaatgatttaaatcgctaaaatgtgcaatatacattaagtgataatgtgatggaaaaaaatgaaactgctgagatggaggtgtggaatgcagtgttaaaagatccataatcagggaaggccttgttgggaaaataatgtttaagcaaaagactttgttacaaaaaaagatagtatattccagacataggtgggactgtcatgcttgaaaaatatcaaggagacccatgtgactgcagcaaagtgagaagttgtggaacatgaggtcagacagttggggaagaaggaggagaggaaaagaggcacataggccactaacatagggctttgtaggacacagcaagtactctggcatatttttctgagaaaattatctcctgttctggaaaaaggagtgacatgatgtaacttaagttgtaagaaatcactctgaatcctctatggaaaatagactgtaaatagctgagggtataacatcaagagcagttggtcttattgtgataatccaggtgagagattatgataatagtaacagatgtcatgaaatgattgtattcgagatatatttcccaaagatagagccaagagtgtttgcaggttgaacagatatgtgttgtaaaacaaaacatttaaatatgactcaaagttttgagcctgaacaaacagaaggaagattgggatagaaagacttggggaggagactggtttaggaagaagattgagtctagttttggatgtgttcagtttgagatgtattcatataataaaaactcaatgtcttcatttgagtggagtccagggtttaggaaaaaagttcaggctggagatataaatttgggatccatcaatgtttagataattttaaggtcagggcacactggatgagctcaccaagagaatggaggtaggaaaaaatgatctaataagggttgagtactgaggtaattcaaagatactaacaataaaagagttaattcacctctcaaaatgtgattgagttcttaagtcagcacataagaaagacaaactgtaaacattaatcttaaactccttaaatctcctctaaatttcagtatatgtggcttggtttataccagaggttaactatggccatagaacaaatcgaggctgctgtctgcttttgttttgtttttttatggcctatgaactaagaattcgttttacatttctaaatgattttttaaaatcaaattaagtatattatatcaaaattctatcaaattcagatttcagtgttcataaaaaaaactttaattacaacacacatgcttatttgtttctgtgttatgtatgactgtctcaactctacaacagcaaagttgaataagtacaacagagactatatgtctcacaaacgctatttgctctccggccctttacagacaaatttgccaaccactggtttatacaattttatacagttgtatctatatgtacagtaaagtgtattatataattaagagtgtgcgtgtgtgtgtgtgtgtgtgtgtgcgagatttcttagggtatttaagctttaaaatatttaaagcatttttttcttatggagctcactgtttcatttgcctgaggtaagctcactgttcttagtaccatatttgaacatctgtttaccaagtacattgcaagcattgtatttagtatgaatttgccacgcccattttagagacaaagtcaaggatcagagaggtcaaaacattatgagaatacaaacttgggtggatctgggttttacatctgggatctcttttactttaccacaaaccctgtcctgccctttggagctaaacatgggggcatcagctctcgttccagccaggtctcaaggaagataccagagacttggaggatattctgagatttagatttgaaaactcagtgaaattagttttaaaaagaaaatgttaaggaattgttacctgcctcaagagatgggagctatctgtttagggaaggggaacaacttagtaaatatatatatttgcttattcataaacttgttttaagaaagtggttgttactggagataaaatggtgaatgacacattaggaaaattttcaaactggcaagcaaacaagcaacttcattatgcaagagatacaaataggatgtgatctcataagactactattatacaatagagtgctagagcttttatttcttaaagagtatatttgagtattcattactaatgtttgaaacttacatcaagtcagtcaataaactacaggcatgcccctgtccagcatgccttttgttgcacagtttttttgacttgaaacttacctatgttgatcttgaagatccaagatcttcttgaatatgtgatctcaaatcatggctgtaacattgatatatacagtgaattaagttcatccctaactactgatataatcagaaaaggacaagagtccttccagggattttggttgaatgaaatgaggtaatagattaagaaaatatttaaaaaactttatgagctattcaagcttgggaagatagctgctctgactgtttttactgtgactaattgaacccctaagaagaacattttgcattttgagaggatatgtgattctgtcacttgtgtctatttatagatagaatatttcagcaagtggcaccttagtggcttggaaatatgaatacagctcaaaagggacactcttttctctctccttgtgagtcttatgacccattacttgatagaatatgtttctaagaaggattttatgtattctgtctctatgatctttacagattccttagtagatagtgtcattaacctcagatctagaattttctgcttttaaaacacaaaagactgtttgcaaattgcataatcacatagtaggcatttactaaatttaaagaaaattaatgctacatagttaacaaatagaaggagatcttgcctgttgactcgcctgacaaagacttccagcaaaccattatgttgttgttctgtcatccttttatcttccaactaacaaataacattctgacagtgttaaaggatatcagaatttttctgcagaaaacagccctgagctgacatcaatgctttcacaaaggaataaaataaaactgtgaagatattagcttgacatcatggggaaaaaattgttgaaatggatttacatctaaatccattatcccatttaatctttgcaaaagaccctgtgatgtaagtgttgtcttcgtttttcctatgaagattccagctcaaggtggtttaataatgcctgtggatacataattaagaaattgtggagaaacaagacctaggtcttattctagtttttgttccctttaaatgatacaatcttgcaatactaccacccccacaaccagaaaatctaaattctcttatttctagagcatctcattatgccatcactattaatcatgaattgctcaggtaagaattagtgcgaatagaatttgagaaaggtatattttgaattctagatggagggagagagaaggaaagattaattttgagcttttagaagagttaactggtaattgttgatgggatctatgcccactggaggacaccttaggactcctccaagcactgtgtggctaaaaatagggtcaaaaatataagaaactcagaatatgtggctgttgctaaaaaacaaactccacatgctttacaactttatccctaattagaaatgccttaggatccactatatggggaattgagacaacaaggacagaaattcttaggagcagcttttgtatatctcctaaataaggctttgaaaaagaccttagataaataagtgcttcactcctaaagatattgttgattaatgagtgattcatacttgccactgctattctttcttgacctcttagtagctggaaagttcataataatcctgaaacatgtagaacaaaagaccgatggtccctgagatcaagaataacctcacaaaaggattcaagctcaccaaatggttcaacagttttccatgttccccaggttgaaggtttcctccttagaaaaagcagccataatctaggaaagttgttgctcaagagaactttctgtgataatgaaaatgttctataaatttgcactgttcactatagtagtcactagctatacctggcttctgagtgcgtaaaatgtgcctagattgattaaagaactgagttttaaattttatttactttaaatttaaatgtaattattcggacagcacacttctagaaaaaagaaagggtgatatgctagacccagagcataccctaaaattgaattgcttttgagacccactgaggaatgtttgagtgacacaaactcctaataattatagaaattcagcctcttctgggaactccacctaattctggattggagatccttggagataactcataactataggctcaggtacaaatgctcatttctattgtaaagactttcaggtgagaatttccagacaatggtctcattcacttctttagcaatcagtaggaccttttactgtaatattctcaagagaataaaagctaaagaaaatatttgtagatattatctttcctctttctactgcatccaaattatactaaatctctattcaaaatttccattttagcctatagtaacattccattcctataactgaagctcatatattaatatttttattacagtccagcatcatacaaagtatagaacctttagttctgagactcaggttcaagcctagctccagtctttactgtccctctgaattgagggtaaccatttaaccttgctcagttttaatattatctgtaaaagggaaatgatatatatatatgtcttttacagaattattgaaggaattaaataagataaatatttatgtatttattttaaataagagaaataaatgctttccaaaactaaataaataaaatgctaggaaaatgtcaacaaatataattactgtcaaccatctgtcctctctctcacagactgaaccttcttcccatttctaaagttatatcctgatacagtttggctgtgtccctacccaagtctcatcttgaattgtggctcccataattctcacatgttgtgggagggagccagtgggagataattgaatcgtgggcgtggtttccccatactgttctcatggtagtgaataagtctcacgagatctgatgattttataaggagtttcctcttttgcttggctctcattttcccttgtctgccaccatgtaaagtgtaccttttgccttctgccatgattgtgagtcctccccagctatgtggaactgtaagtccattaaatgtctttcctttataaattacccagtctcagatatgtctttattagcagcatgagaacagactaatacatatcactaataatatcctatattcacatagaacactatattcacagtctgcttttaaatataagatactgcatgtatttactgcctaatgtcacctagattctctcctagaccctggtcaaatagccatgcaaattacatcttctagaaatattctgaaaatagatttgatacataattgttgtatacagtaaacaaccgtgggtttcatgtgttctcatcctggtatgaaaatttttgtcaactactccaaagctgttaatctaatatctaattattttaagtagcaattccagttaaaaatattacctcatgcagaaaattggaaagttagggaaaatacaatgctagaaagttagcatttcattgggcctcaccaccagcaataatgattgttaaaataattaacaagtaattaatgctattatttaatttctatgcttggattaataagttctagagattttgctttgttcagtacttgtatttcctcttctatatactctgcatccttgctattgcccgtttatttgtcaggaccttagtatattgattatcaattcatgggagcacatactgcataaaagatgatgataccacttgatctttcatatttgttataatattttattcccaatgcctttttaaagcttttaacataagttgaggatctaatttttaaatttttatgtacttaaatctgcaattatgcttctctctaaattttttctttattttgtaaattatctgctctccagtaatttgaccaattgtcagatttggtctctccataccaatatgtcacctatagatgttgttttttctcaactgtctttgctcataatattggagcaaatacaattaagagctcaaattgccagacaaagtcatagaaggaaaatgtttggtcttttcaattctgcccaacttgaaatgatggacaaagtttataatcatagattttcactgaaggcaaaagggactagccacatattgctgtaggtgtgtggtatgtgtgaccttctttcatgttcagcacaactctcagaagtagttagtattcttatttacatggtaagaaactgatgctatgagggactaagtaacattctaagatcatactgctagaaattagtggatctggcttccttatccaggttcagttggctcaaagtcagtatgctcttccctggactgtgatatttggaaggccacttaccttatcagaagtgtttttaaaaaatcaagtacattcatattaatgattctgtaataaccactaattatcaaactttactaagaagcagttcctgcttaagacctgtcatgctttatcttatttgagattgactgtaattctatagcattgtgttatatccctgtgttaaagattaggaaacagaagcccaaggtcacagaattatcaagtattggagagaggcttataatcttggtcttggttctaactcctggcgcttaaccactgtgcaatcctgcctcaaactactgtatacggtgtcatactttaaatgacttcccagtcatttgagagtgggaagaacctacccaaatgaatggctacccaaacagcttctttagcatatttgttaaattaggcacttgttatatactcacttccatttgaatagtgttaatagtgcttaatagtttctcggtgttacagtgtgctttggttggttggttggttttaagtatactttctattagtcagagattagagtcaaaagggaagaaacacccacacagtcacaggtttcctggcatgtcctagagctcctttgaaaaatgtgttcattccctcctgacaggagccctgaccccgaagtctgtcagattcataacaaagccatggcatctattttatgtttggggctggcccatctctcatgtgctatcacttgcttcccaaaggtgcatcccagcaggggaatctatttgaggaagtcccaatgtcattttatactagatggtaggaaaaccttcacaaagccctctttgtcactgttattctacaaggtcctggaaatacacttgaatatctagcgctccggagtttgcatgttattcagaggtgagcattcaggatgaaagtgcatagtcagaatcaaacagagcctttccagaagtttttaaagggtcatggaaatgaaaagactagtgaattctttcagataattctgcctttctacatttctcactagatttttagaaatgaacactgaaatttcaagataacatttgttgcaggttcactaaactaccttaaataccaaattatttaaaattaccacaacatttaaaagattgtaacaactcatatgtgctgtattaatcaaatgcaattttagagagtaccaagaatgtctccacaaatgtccacatgagcaatcgtcagtaaacaggcacgtataatccaaggagagagctataaagcaagagcctaaggatctacatttgattatcatcatcattaataattagacacataattgatgggatatgtcattagatttaccctgttaaattttcctatccatgaaatgtggataaaatacaactgttttaactggtttacaagaaaattgcaaggatcatctaagtaccacctaaaatagtttaaagcactttttaaatgaaagaaactaatttctaggttttgctcctccctgaccaaaatataaatgaacaagctataagtcttgaatcataaatatatcccttagaaactggaaaagtcagaatgttctattgcataaaatcaaattattcacaaacaacattgctgttaggtcaaacattaaagctgccacaagtcatcttttagtatgtggatgagcatggcaatttactatgatatcattcaaattgggaaaggccctagaaatggatgtaaatccaaaccctaggttgacacaggtgcagagagagaagccaggaaggggggagatggacatatccagaatcagatgctgggatgatgtccaagccagtaaacagacttaataacctaaatctctggacactgataaataagtgccattcaggcccacaggcaatataaattgggtccagtgttaagtaactcaatgttcttgcacatgtttgccaagcatggcaatgctggatggaaagcagaagtaggaccatattagaggagtccagtggaagtatcaggaatctagccattagactgtgcagttcaaaaacagatgtcagttctaagtgttgctaacagcaaggtaggattttggtaacctaaagtctatgggattcaaggacaaaagaaaaaaccagaagaaatttttatcaaaaatagaacgttagttcagagtgagaatagtagtgtctagtttattcatttgtgcattcaacaaacatccattaactcctgtgatggttaacattgagtgtcaacttgattggattgaagggtgcaaagtattgttcctggttatgtctgtgagggtgttgccaaaggagattaacatttgagtcagtggactgggcgaggcagacccatcctcaatatgagtgagcaccatttaaatcagctgccagcacagctagaataaagcaggcagaagaacgtggaaggactagactggctgactcttctggccttcatctttctcccatgctggatgcttcctgccctccaatgttggactccaagttcttcagcttttgtattcttggacttacaccagtggtttgccaggggctctcgggctttcagccacagattgaaggctgcactgtcagcttccctacttttgaggtttggggacttggactggcttagttgatccacagcttgcagacagcctattgtggaacttcaccgtgtgactgtgtcagtcaatactccttaattaactcactttcctgtatatatctatcatattagtcctatccctctagagaactctgactaatacactccctactatgtgcaaatgaatatgctagtttcagtaatgtgtggcgggggaaggtacagtagccctcatatgctcatgagggtgagcagagggcaattagcattgtgtagcagcagtggaaggcagtggggaccaggcaaaaacttaagagaacttcacacttacagcaggtgttcagtgataagtagaaactagcagttctactttgagaagaatatttagagcagagaaaatgtgtttttaaatgcctgttttattggagaacagtaaacagtttgatgttgatgaagattaaggtaggtatgggaaacgcagtggagctggtggcagggtagttggggacacaggatttgcagctgcaaagacaggaaacttagaggtctgtgaaggttcacgtgtgccatgtaagagcctgagtctgcatcaggaagcacttgaggaggccctgaaggacttgcaacaacaaagaatgactttgcgctttggctgtgattcagtcaaagctttaatggcaagaccatggaatatcttttggaaatggtgtcataaagcttgattttattatgttgaaggatctctgagtaaagctgaatttgtcatttggaaatatgaattaactttatcatattcttcttgcatcttgttgatgtttgccgttgtgagcttcaagaactgaattgaaaaaaaaatgcaatagaccagagctctggccgggcaaggtggctcacgcctgtaatcccagcactttgggaggccgagacaggcggatcacgaggtcaggagattgagaccatcctggctaacacggtgaaaccccgtctctactaaaaatacaaaaaattagccgggcatggtggcgggcacctgtagtcccagctactctggaggctgaggcaggagaatggcgtgaaccctggaggcggagtttgcagtgagctgagatggcgccactgcagtccagcctgggcgacaaagcgagactccgtctcaaaaaaaaaaaaaaaaaaaaaaaaaaaaaaaaaaaaaagccagagctctattttatgagatcactctgtcacttgtatacaataaattttgtataagaccatatcgatctatgtatctatcacaaggaatagtgtaggttctaaacactttgatcaataaaacaagtagttttatatatgcatataaaaaggaagaaataaaacatattaatcaagcatagactataaaaacttctccacagggttcatttttctttgaaacaaactactagatgttttaggaaatctaatttcatgtgaagttttgctgcattttagttccatgaggaaaatttttcattcatactttttcagtgtcatttgataacaatacaaactagttcatatattcttttagagaatgtacttcacaatttgatttggttgcaatgttcataatatgctaccaaaaaattagtatcccttttaataaataagttgaagttaaaggaaatacccagtattgctgcacctgcctcaatcccatttctttacatgaaccggcctcatctgtgcactaataataaagctgaaccatggacatgccactgcagttggcctcccatagctctgcactacctgtttctgttctgggacagtttataagattatgccaagactggtttcccccaaacttgtctttgagtctcaggtagataaaacaggtatttacttttcagaaaagtaaagtccatagctatttattgaatgcttgctaatattgttaggcacagttctaggtgctgttcatgcattgtcacatgtaaggctcacagccaatgaggtaggtacttttattactcccagattacaaaggagaaatttgaggctcagacaggtgaaataacttctcaaagtcacccacagaagaagcagttgtatacaatgagcttgaattgaatgcaagttagtcaggctccatagctcataacttgccaacaccacattcttcttatactgtggtcaatactatgagaaatgtttcccacactacataagtttcttcaatgtacctcctagggttagtactttcaatgtgcctcccacttagggtacctagtcagtgtcctcactgtctttcagctctgtctactgaaatttagcctctccttggtttctgtggaatttggcaagtccagtgcagtgtctaactgggaccatctccttttggcagcatcaagttaggcttactgttagtatcctccaaacttgttgctctggtttgctggcagctggagtctagctttgacagttactcagaaatggagcattggccttttttctctagtgactcggtagttctttgaagaaagtcatgggaagaatatgagctttacactacaatgacctgaatgcaaacatcaactcagccatttattgttgtgcagcttttgtcaagtgatttgacctctttgagcctcagtttatcatctatataatggatattaaaatatatacatcattaggctttttgtcaatttaaattaaataatagaatctctctatattcatggaacccctgtatagttagcactcaatgaacctgccttgttacaactttaaaaaaattatattcacttaaaaaaatggggtataactgaggtttacatatgaagttatgggatacatatagatagtaaaatggttattacagtgaagcagactaacatatccatcacctcacatagttacgtgtgtgtggtgtgacaggagcagctaaaatctaggtatttaagaaagatccctaatacaatacaaatttattaatagtcctcatgttgtatattacatctctagacttgttcatcctacacatctgctactttgtattcgttggtatctccccattttctctcctccaccctgggccctgttagccctagattttttctgcaagtttgacctttttattttaatttcacatgtaattgagatcatgcaacattttttctttcagtgtctggcttatttcacttagcataatgccctctgggtccatccatgttgtggcggatggcaagatatcctttattcttgctgaataatattccattgtgtaggatgggtatatatatgccacatttcctttatccagttgactttggtcgtttccatatcttggctattgtgaacaatgctgcagtgaacatgggaatgaagatatctttacaaggtggtgatttcatctccttcagatatatatcaagaagatggattgctgggtcatatggtaatctatttttaacatatttaggaaccatcatactgacttccataatagctacaccaatcaacattttcaccaacagtgtataagggttttcttctctctacccccaccaccgtttgctatcacttgtctcattgataagagccatattaatgggtgtgaggtgatatttttatagtggttttcatttgcatatccctgatgattaaacatacattttcatatacctgttggcatttttatatcttctttggagaaatttctgttcaggtcttttgcacattttttaattgggttgtttttctgctattgagttgtgagggttttaaattttgaatatcaatcccttatcagatatgtgggttacaaatatttttcccactccacaggttgccttttaattttgttttttcctttgccagacagatagatgccttttagtttgatgtagtcctttttttttttttttttttttttttttttttttttttttgctgttgtagctgagcttttggtgtgatatctaaaaaatcttggccatggccatgtcagtttttcctctacgttcccttctaagacttttatggtttcagatcttacatttaagtcctttgttcattttgagttattctttctggatggtgtgaaatggtggttcaatctcactttttttttttttgaatgtggaaactcacttctgcaagcaccgtttatcgaagagaccacccttttccccattgtgttctcttggtgcccttgttgaaaattagctgatcataaatgtttggatttatttctaggttctcttctattccaccggtcgatgtttctgtttatctgccagacatcatacttcgtgattttaaattataatttgtaaccttagtttctcacagcagttctctctactgcttcttcatgtcagggttcttctactcgaatgccagtgtttctatacatagaatttcccattgttttctctgacactaactttctacctgactggatttctgccattgcctgccataacccttcccagtcagaaattagattcagttggaattgaatcataatccatttaatttttaccttttcttttgtggactgattttggccttacaaatgaccttaagcttttcagaccccactcaactgccattagaatactacacggcagctttgtccccacgcccagccacatgtttttcttcttcccaagctcaggttgtatagcctgtagatattcatacctgaccaagtacttttggatgtgccatctcatttaatttttgcagtaattctgttgaagcactgtaaaaggtcacatgagataacggagacttgccttttaaaaatatttagttaaaccacatgacatggctgatatttggatatctttgacctacaaaaacaatttcttaggattcaatctaatccttccttgaatatgcaagatatgagttcttaaatagttttagttcacgaagcgcatcagcacaggtacatataaatgtcacacttcattctgatattgtatttgccacactaaaatgaggaaaggcatcttatgttttcttttggcataaagcacaggattccaagggactaagatataatatgatataataaaagctcattgtagtgctgggaaaagtaagtcattcattatcattactgctaatatgtgtaactgataaccccagagtttatttataaatgtagcaagtatttctcacagcatccacaagacaatttttagttcgagaggctgcataaaatgagtactttcccaatacccatttaggcaaaattatccactcaataaaaatgttctagaactttggacactgtgttctgaggtcggattgtttttgataatagattatgaggtcatgtttttctcttgtaccagtgtaccaagaagaggatttaaattttcttagtgacaggaatctcagtctgggccttctgactttcttcctgccagtatctttaattgccatgtgttcttattgagaagaaaagttgtcatcaggttctctttgatattaaaatggtttcaaacacctcgatttgatttaatttaggtctgatattgctaagcctctactaaacacaatttcaaatgatttctctttgatcactattctattggtgagataaacttctcagaagtggcttaaaatctgtttgctttgttttttgacaaagttatctacagatttgcccattagctttttcctattaatcaagttaatttaaatctaactgctaagtaggttttccttagaactctttttaaaaaaactgttgaagaaatgtgtctctggtggattattctgatttcctaaactcagactctaaaattgtgtgttttcatttaagagtctgagaattgctagtgttcaatttgctcagattggattttagttatgagaaatctagacacatggaaaaaagtgctttttaatcagttcttgaaatcaatatagcaataaagcaatacatgagaaattattttgaaaaaaattgtatagggtggatgtcacagagtattctacatgaatactcatttcatatcttgcatgaggtactttatcatttacactaaattattctacttaggaaacttcatcactggcacatctttttgtaaataactacctttcctcaattttatatgtccaatatattctactttaggtcagtttttcccaaacctccgccattaatttacttacctttttattacctttgccatattctaatccatatttatttgtttctttaaattgattttcaatcttcttatacttctaactgagccttaaactataaaactatatgttgatgcatatttttcaaatgtacattaaataaatactttgctgttagcacataaattgataaccatgtactacctatagttattatgtcttccactagactagataccataggtatctgtttaggaaaagcttttggttgtcttatatgatctatataaatatagatatttgataatacctgtttttattaacctgaagattgattgaaatgaaataaaactgtgggaacttagtgtataaaaaagaacattatatttggtattacatgaactagaagatctatcttctaattgcttttgtacctcctgcttgcaatatagttttggggacgtacatttccaaggtcaaaccagttgctgcatctacacattaaagacatagaatcattaaaataatctctaagatctcttttagctcttaactttctaggagagtcaaaaattctttgtagcactcttggatgacttatttggggcaatatgtattctaagctgcattactgctatattttgtaattaaaatattttgtattactggtgagtattaacctttaattttcatatttcatgtgagttgtcttctctttattagagttagatgtttgtcctggtgtcccagttctattcccactttctcattcaactacatgcacagtgtaagaagtggggtgctgctgacatttaaggcgtgtaaaaaggcatgcaaattatttagctagctgagtttagtcactagcaggtagtaatcatgagccattgtgcatagtggatgacaacggcgaaaatacctgacttgtatctttcctatgacattaggcaagcttatcaaatattctgatcctccatgttgtcacctgaaacaaagcttcattactgaaggatatgggtcaagggatgactggtcattcactgggatagtcatgatactcatttatatcccagtatcagtcacatttgacattcagctggagtgatggcagatgtagataacatcggtctttcagtgtatgcttcatggaggataatgatggtttgcagctattatgttcaaatgggacttagaaaatagcctactaattaaatgactaaatcaaataaaactacacattttaaaatttctcctttatttaaacttagcaaattatattttttgatcttctatactgagtttctgacttactcatctcagcccaatttgtgtatatctgagctttgagtggaatgtgcccttccaaactataatacttctatagaatgtgaatatttttacacgttgcttatggaacactcaacttcttgaaattctcatctgatttgctttgctcttacacaaattacatgtgctacacatatatacattgaaacaaagccacttttccaaacagcaagttctcttaccatggaagtgtgatccagttatctttgatatttcatttctcttaaatatcttttagcaacacacatcttagaaagtgttgtcattttttataaggtgatatattttaggtgaattttcatatttgtagaaacctattttttccactcttcactaaatgaactcagatttggttactcatactaaatgctctggctaaacatcaacgaacagaaatcatttatcagtctaaaccaactttatatgcatttatagaatatattcactttcatataaaattttacaattccgtatatattaaagcactatctggactcaaaatcactaaatttgaagtttctatgtaatataataacttctaaaatgggaggtttatacaatactacaaaggaaaatcatatttggatccatgggttttatttgcttttttgattttttttcttttcaggattacaaacaataagtcttactgtttttcaaattatatccttatttgctaatttgatttacaaatgcacatgatctttgagcacattttctttgcatcattccaatgtttacgctgctaacttaactacttagatacttgccacgtacagtctctagctctttatgagaagctacaatggaagaaatgtgtgacttgcattcatagtactgtgaatctgttcactcactgaaattcactaaaaacagaacctgttttcagccattccttgtttcaatctgcattccttgtctgaataactgtaataaaataggacaaaacaaattttgatgggcaatttcatcgtagcccatctgttcggttatgctgggaggcaggaacctagtcttatctgtcctgctgtttgcagggctgtcttaataaagtttggtgaatcagaactacaaggtatttcatttacttctatgtgtattcctgtgttttgactttccttcccctgcccttcacagtggagttaaagcaggaatctagtggcatcagagattggagtctaaatgaggttgaaactagaccgggtatcctattcaaggtagtcttgaaaatagagcatcagcgggacaagtcccaggtagccactagggaaaactgagattcaaacactaggaaaccaaatatatactccaagttcaaatgacaagagaaatctaaagtgaagtttcagagccaagagtgagcaggtgggcagagaccagatcagctctggagctgatcataatccagtagggagaattgctgcctgtagcgatggttcctggaactaccattcacctactggaggcttcctagaattgaaagatcatgaaaatgtggacaactaccttaagagctaaaacgaggcaaaggtgagacttacggtcatctcttaccttcctggtaaaatttctcagatcatctgatacaatgtaagacaatctgcttgtgatccataggccactcgttcttcctccaaaatggccttgtacatgttactatattttatttgaatgtaaacacaattaccaagcagtaaataatgattttccttacccattgattagtgcatgttgatactgaagatgcattgatttgtacaagcctagcttgaaatggagcagatgggtatgtaaaggtttactcaaaatcaatgtgaattagattgctgctcctcagtaaaatgaattataagttagaatggctattttctttaacttaatgtaatagaatgctgtctaaggcaatctgttaaggtagacttactgaaaatgtagcctttgatctcaaaaataagcattcccaaaacaacatgatttaatgagcaaagacaatattatgtctaagaaaatgtagttaaggcattgtagcaaatgtcctggaaaaatgtttgacaataaacttgttttcttttaaaaaataataatcatgttctttcgagttatacagtattacactgactgctttttttccttgattgtttgtaaatattcacatatacatatgttacagtggtttaatcactgtactgctcacagtgcagcagtgctgatggatagcttttgttaaagaaatatcattaacatttatatccttgtttactgctgttgcttacaatgtaaagaaaacaataatccatttatagtccactggctgtatattcaggctttgttcattcctttaaaaagaatagtccaaccattcatgttcctgaaatattaagggaataggccattctttgtccaacttcttaaatagatctttgagtttcggaaaaactatgggggagagaaatgtgtcaaaggaagtaccacagactgtgttttatcccagtatagggtgctgctttcgcagaaaagcgaaaaacattcccaaataagagtatatttttgttttgctactggaattattcctcagatggcttgtgcctgtttttagagtgatacaaatttgcaacgtgtacctatgtgtggatggatgtctcataagtctattgtcataaatgtgactattcagtatatctttattgagcacgtatgttgtaccaagtaacatactgtgtactagaaatttaaagaaatagaaagcagagctcctgctttcaaggaactcagtttgatgtggcaccatgatagctctcaggcaatttaagtctatacaagaattcagagaaggaaggatgagattaatccagccaaaaagggttgaggcatttgacttgggattataaagatgaatcatactttagaagcatggggaaggggagtgaagatggggttggttaaaaacctaggaaatttgaaaacaaaaaatgaaaatacaaaacacaatttggaaagatgggttatgtaaaacaattggagcatggagtgagtggtggggaagaaagtaaagtgatcttgcataaatagcctaatttctctacatatttttcatattaaacacccaaaagaacagcttatttttgtctgatatttaagttatgtttataaagattttattgagcagaatgtgatcaacactgctggtattacaaagcataggggcatgttgtagattaatttgtatgatgtatccatatacggtttatatgcatatatagcataaacgcttccttcaagattggtatatgtgtaacctaaattagtctctagctccaattctgatactgtttaagtatgtaacattggctaagttataacatttctaaaatgtaactagacggtctataattctttcagccaaaaccttttggagtgatcttatgactttgtgattcaaggctgaatatttggaatcagactgtcctggattgaaatcctagctctcctgcttgccagttgtgtaaactttatcattttgctgtaatacagtgcattctctaatcctcaaatccctcttatataaaactaaaaatagtgtctatctcataggattgcctttagatttagtgtaaagtgcttagcccatttctgtcacatagtgagtacttaacagatgctgcctattactattgtgcgattccatactgattagtaaaagaatcatatccacttaatttctgggcctttgaatgtcaaaaactaggcctgtgtcattctaataagcatgattaggctttttaaataaacattattcacctcagtcttgggcagtgatttctcatgcttgaattttagttttggctttcctaagacttcttagtttagcttctggcactctttccaagacttatttattttggaaaactaatatgactcatctctcaagataactggcccttgactgccatacttgatttagtttgcccacagttcttggtaaaagatcctgctactactgagcccagtcccatggaatcagctctaactaagctatcacttcagacatagaagagtaaagaacaaagagtaaagaaggcaatgaagataaacaactgagtgtccacaggaactggtggcaccctattttcacaaaagaattggcattaagaattggaatggtccttggaagtttctattctaacacatattttcagagtgtaaaaaatgatcacaaattctacccccacccccaccccaccccacatcaagaagtgagtctatctagtttctcgcttcttgagtctggactagtcttattacttgcttttctgacatacatgacatagaataaaatagagtaggttttgattctcagactaaagatttgtatatttcatctctctctctcccccacctctcctttcatcttttcctctctctctttctctttttctctcggagaatgtttagcatatgagcaagccagtttaaactattggtgggtgagagaccatgtgtagagaggtcccattcatcccagtctttctagtcaaagtcatcttaaactagccaacccccacccaacccaaaagctcttgccaaatgcaagagaaaacttgatatacaagaagaaaaaataaagcccagctaagcccagacaaattgttgacttacagaattatgagctaaaaaaactggtcattgttttatgcactaagttttgcataactgctatactaagcaatgcatgaatcacctctaaaatactgcctacaagtggccaaatagctattgcattaaggaagaaattttctccccacattcattttcatgagtgtgaggatactatatggctcaataattagcgtaggtcaacctttcaaaccctttaaagtattaaagtaatcacgtgagttttcattataacagatttaaatcacaaatgaaattgtcagtttatttttgagttaccaaattccttacacagcttttaaagttgcattgtacactgttttgctttctcatttactttaacccagaaatactttctaagcttaagtacattcaaaacttgtttttttctcacctgattctactgatctctgggatttgttattttcagaatccattgtttgttttgctaactttttctcgcactgtattacctttcttggcttaaaaacccaataggcttggtaagccagatgtacgcctgtccaaccagctcaccccagtttgaatcactactctttcatcttctctgccttcccagtatggcttagatattctcaagccttggcttgcttccagtcttttcagaacagtattctgaattatgtctatagcatttgttttaacttttttttgtggagcggggggaagctcaaatgttctgattatttattctgtggatttctgcagtggaccagtgaggattctgcctgtcatagttatctccatcaatccatcagctaattgcacgaccttttcttaaaaatgcaattttgttgcaatcactgttctgcacactctgacccattatggtgatgaaagaaaattaaaccacattctaaaatatgaaaaaaagcaaagaacagtgtgatgaaatgaaatggttatgtctatatgctgaaatgtaaatgtgggcaaattctttttctgtagggagtttttatgtgaagctcttttggaataaatataaaagataaagactggagttaaatagaagtgttgaattgactccccagacctatgccttccacatcatgtttatgcaattgtgttttaaagtcaatgtctatattcatctgaaaatatcacccaagtgctttatcccatctacaaaaagaatcatatttgagaactgcctagtgggtaggcatagacgtctcaatccctgtatagccttgagatgaaactatctagggggtctaaaaaatgaaagtcttcaacatatatctttcaataattattttttgtgttaagaacattaaaaatccatcatccttgaattaaaaattgcatgagctaaaaatcacacaggttatatatattgaatggaataaaatgagaagtatactatattgaccagaggtaagatactgttgtattatccttacagaatttaaatgaaatcataatttctatttataggcaagctatatggtattgagacaaggaaataatttacaactgttatagttatagaaaggttatttctaattttatctcatggagttaaaatagaaacttaattttaagttaatctcacttttgggagtgtaatagtgcaacctctttgttagcaagaatatttttaacctaactgtataaagcattaacacattgtgtaatatcacttatcctgtaggaaatcatcaaaatctgatgattacggaagactggctttacaagttcaagggagaatatctcgactccagtaaattccatcaagactgagaaaagtgtgatcacgggcagttagaaagtatagcaaattcatatccttaggctgctttctaaggatatcagtgaaaatgaaatcagacctttcttaaaatgcggttatctaacacagtattttagaattaaacttttaatctgttttcttatatgactattgagtattgttatccttcacttttgttgttttgttttgttttgttttgttttgttttgttttgttttgttttgagacggagtctcactctctctcccgggctggaatgcgatggcgcgatcttggctcaccgcaactccacctcccgagttcaagcgattcccttgcctcagcctcccaagtagctggaattacaagctcctgccaccatacctggctaatttttgtatatttagtagagacggggttttgccatgttggctaagctggtcttgaactcctgacctcaagtgattcgcccgcctcggccttccaaaagtgctgggattacaggcgtaagccacttcaccaaagagttatccttcactttttatgtacatttgcattcttgtactttttgcaaaaatataactgccagtttagcacctactagacaaactagttcaacatcgttcaattttcacatgaaaattagcatcccacctagttggggtgatcttcccattctgttcttttttcttttcaaatgagtaaaatcattaacttcatagaggctttatttatccatttatcctattcactgaacacctttaccaagtgtgttactagtttagtctctgggtttctaagaatagatacgttttttcctaagcaggtcacaatcaattgttggatataaatgattttcatacaactaattcccaagcatacccttcaatttaaaccagagcaatacagctacccaccctcaaagacaaaaggaaaaatatatttgtgctctatttataaattgccaatattttaaaaagagaatgaaaaactttgaccttatgctagaacttgccgtttttattataaaaagttccacaatttcatctgtgcattactatgattcatcccaaaattgttttaaagggtaagtattcccaataaaattaagattcaatttggaaacaatatatctatttcataaagtaaggtggacttctgtgacaagatcatcctatagatgaattgagacttgactgaagtaaggaaatgtttcttcaccagctttattcagagaaagtggcttaagtcatcgacttaggattccattgtctgcattctttcctgttagatactcagtaaatataattagattgattaactgactaaacaagtcttacttactgcatgagaagaactatctctgtaaaaggaaatctcccttagcagccaaattttctgaatgatgtcttcaatgtgaagagtaataagtattttcctccacagaaacctgacccaatatcagcctggtgaagagacctagacctctggccattagtgtgaagtcaatgctattgacaatcatcaaagattttcatcctttccactagagtacttaagaactaaatatcattgatgagaactaaagcctgttgatgtgttcctgtaattttaattaataatacattaaatttttttcctgattgtatgaacatatatcatttaacaatgatttataccaaagccattaggaaagatttagtgtcatatcacagccagttattctcttttcttcttccttacccctaaaaaatgtcccagatgcagaaagtcataatctgatattcagatatttacatttaaaaggttcctgtcttttaaagagttttcaaagttctatctttgtctaaaatatatagtttagaaaatataatgtacatgtgtattgcatatatgtatattacaaatttaaggatgtatatgtcactcgctatatatgtaattaacatatttaatcatgagcactatgccttgcatatgtagcacagcctcagacataagtcatacctagagaggagtgtgatggaaacaaccagaacctcgtaacaagattgagtaaaccaactgacatcttttagactgagatatcaagtacaatgagttaaactgttaaagcaaattcaaatctgctccaagtgagcattaatttttaacatgtattatacatgtcacgacttctgagcagtgttaatcaggtgagaattctcagatgagaactaaggttatatgtcaaggaagcgggaatttgcgcaccgtgggaagaattcctctgtatgatggacagaaacagagttggagtccaacaatgattactgtgtggaaagtgatcaccagagaagagggaaggcggaaagtatagttacacaaaaaagcaagtctaagtttcaatcaggtgatctcaaataagtcaattccaaatgtcacttaaggtacagggactccaacaaactgtgtcaaacatttaaggtgagcatatagggactgattagactggattatgaatgatatgtaaaggaagaaataccatggaatactctcccttagaccaggttggacactgtgaaatgaatgggtttcattgttgctactttttatgttcattattttagttaaataaactccttttttaaaaaaaaattgaaattatataacagagtaaaaatagaattcactttttacagtgtagagagtttctggttataaaacagctgagatgtaaaccataaatgagatgaaacataagtgattcgaacataagcaagatcattctaaaaataactatcagggaacaagggagttcaagatgttaagatcccttatctatgtggaaaaatggatgataactttgtcaatcccctctctagaaatgaaaacaaagaaaaatttaaaaatgaaaaggttattagcaaatggtccagaagtaggccaggcagtagaaagcatgattttgttagccattagttacatagagcaggttatgtacgtccctacctggaaagtcataaaacattcctgaaaatcctagctggcatttccagcaaattgtgagagaacacagtttacattctgaagcccaagaagcattgtttttttaatattatgtaccatttcactacttaccatttcaagagtataaaataacaatagaattggccttctcattctgatattttagaaaattccacattttcacggttcctattgcaaacaagaataaaatcttttggcagagcctgactataaaaagatctagaagctattcttataatgtaaaaaaagagtatgtttttatgaccttgccaatttctctattgataaagagtaggaagtgtggatatgatctataaacatatttttaaatgacaggcatagataaagaattctctgaagcagaataatttatggaacaaaagcagttaaggatgaaaacatttatcatgggaaatgggaatactgtgagtaaaaagttcaagaataaagtatgatttatgataatagagattctcacaatattttcagaactatagttgaataaaaatatgtagtatttgattgaaaaccaaaacagtggattaatgtaactagaaaagtttgggtttgggccaacagcggacattgaaatatgagtatatttttagaataaacatctatatatagctccagtgaattcactttgattaaaagataattcaatggataaattggataaaatatgtaaaaaaaaaattctctggctctgatgacaaaaaggcagtttcacagatttgctatcagaaattactttttcatagaaacctacatatatttctcttttattctgatatgagcttctcatgtgagattagtcagtgtgaaggccagtatagctcagacaaagctgaccacagcatagaaacccctgccaacactaaggtcacacccctctctggggtgtgactgaccagatgcaggcctgtctttcccaaagaaccatggctgccacttctgtgggatgaaggccttttttaatggagaatatctagtcaaatgtctccgtaatattaccttcattgttcgtagagtaaaatgtaaagggttttaacttcagaggaactgtgcacaggcagggaggtgggtgaagttgacctaatgcagagatggggagccacagctcagggtcaggtttgtcatctcttaattctgtttatgccattgacttgttattggatggtgcacaggtaattgatttatctggctaagttttcttattactaaaatgaagttaacatctgcatcatacagttataggaacagggcctgggacagaggaaactctcggtaaatgttggctattgtaattattaccttagtatgacatcctcccgaattcttcataactttttggtaactggtaagagatgttgaggggtaacaagatcctgctggggtaccattctccttgacttccttcaaaggtcagattttgctggccttaaaccacaagtcatcagtaaatgtaccattgtgttccggaattgtaaagtatctagtggaggctttaagaagacaccgagttgttgttgttgttgttgttgttttcaggattatacttaatttagtcaagacagatttcttgtgatgtaggttccgtgtcttgaataaataagtacaattctggaaaaaaaatgtttcaaataatggtaatattagggagacatataaaaaatttagggagccctaaaaagcctgagatagaattggtttcagatgacactaagtatctcgtatttccaaggtactttgggagaggcagcatggcactatagaaagagcacaaactttgtaaacagactggactaagtcctgctcacttacatgtaacctggggtaagattcatttatagaagcttcaattttcttgactgacgtaatacatatgtgcctgatttctgtgaaaattaagaaatgaatgtacaataccaaaataatacttcagtgtcagctctcaggaaaggaaaatcaaagacctctgtttaagcattgcatgtttgctgataccatgtcagtaccacacatagcttcctcaaaccatttgagtaattcttagatcctggattctcttgggttctatggtttgaatatttggcccctccaaagttaatgttgaaatttagtccatccataaggacaaagccctcatgagccagtctcctcttaaagtgccacagtagagattaagtttcaacatgaggtttagagggggcagatattcgaatcacagcaggctgctataacagaataccatagactaggtagcttaaacaacagaaattaattcctcaaagtgctggaggctgagaagaccaagattaaggtgtcaatgaagtttcattccaaagcatcttctcttggttgataggcttctcgctgtgtgctcacatgaattctttacaatgtgtgtgtagagggggagaaagatatttaaatttctgcccagtctcttgaaagatcaccttggctttcatctcataattctcacctgatccatactgttcagaagtcttaacatacataatccattttagaaatgatgtggccatgaatcctattggattggagccctgccctgagatttcattttttaaattttcctctgaaagactctattttcaaatataatcatattgggggttagtgtttcaacatatgaagtttaggtgggggatacaagtcagtctcattgaagataataaggcataattactgagggggatttatatataggtagaaaagtagagtgggaacagatcttgaaggtcttctagactagtctaaggggtttgattttatcctaagagatccaaaaatcattgaacaggtttaaaacaacaaagtctgatatgcgtttttcaaaaaattactctggtggctatgtggaatattagatgtaaagaggaaaaagcataaacaggaaaactagttaagactacttcacagtcaaaaaataacttgggtgaggacagcagtaggagaaatggcataagtgaaatgggctaagatatgacatagagttagtcaacagggtttgtgaataaagttaatgaaagggaatgatgaaatagaagcacaaagtcttctaagtttcttatgagctgctgtgtggttagaggtaccatttgctaaaatggagaagattgaaggaagaacattttggggttgggttgggctagatccagagttttgtttttagatttgttgaggtgcccttctagatattcaagtgtaggtgtcaaataggcagacttataaatcttgagttaaatcaggcttagtgttaacttaagagttatagataatatttaaatccatgtaacaatttgaaaattatagctagtatttaaatccactggactaaatgagatgccctaggaagaaagtttccattaaaacaaaagagtctcagaattaagtctcagggcacaacatttagaaggccaacataagaggaggcaccaacaaagagaaccaaagatggctataaagttagaaaaccagaagaatgtggtgtcatggaagccaagaaaagataagctagcaagaagggaataggcacctgagtgaaaccctgctgagaagggaagatgaagacaaagaagtgactatgagatcaggttacatgggaggaattggtgacttagaggagtttcaatggagtggtgttgatagaagccacctaagtgtagattgaaggcagaataggaagtgtggaaatggaaaatgacaacatatgctagtgtcccttaaccccagatccacccatggaactttagagaatttccaatgcctgatcccataccagaagtagagggatgaacttgaaagtatttttgaagctggagtatttttaatgagtttccaggtaattataatgttgctgtcaatgttgtgaatcactattatagacaaatgtttctagaagtttttgagtgtgtgtgacagcagaggggtgaccatgtggcaagaaaagtatatgttgttattactgtagttttgattgtatttttaatagaaaatacaagaggatattatgaattcatgaggaaaatcctatataaagggagagaaactgatgattcaggattaagaggaaacaatagcaaaaggaaatttcttgaggagggcagaggggacagaaactctgcataattttagaaatcacatctgatggtaacaagggtaggcattttcgttttaaccactggaggaactcaacttgcttggtttgcacctatactctgatcctgagtagggaaaggtagaaaacaaggccttaagctttttttgtgtgtgtgtgctttaattaaatcttaatttcccatagaaacattagtcttggagtcatgatcaggaggtaagtcaacatacacataaaaatactcacctatcctttatttagttaaataagaatggacaatccattaatctatttaatacagaactttccaaagtttaagtacacaagtttaaccacttatacctgacatagacaaatatataaataaaatgaaaattcattgcctaaactgatattcaatgagttattacaacatattaggaagagatgctctcatcaagaatgggaaataaaggttacttttcagtcaatagtacagaaagctttgaagattctaaagcttaatgtcttcataaaaaattagccttttctcagattgtaaagaagttacctggatttgtaaagaaaagaagtggtttaattcaacctccagaatccaccaaattgagtgagattttattgtcacactattttgaaattcgtctagttcaagagaagaatagaatttgctcagggttgtaatccaaagaagtcaagacctcagcatatggaagaatcctctaatccccagatgtactgattgatttgtgcggctgcaaatttttcctaacaactagaggcaatagaaaatagatttctggtccctggagccctattaagaaataagtttgcattcagatatctatgtacaaatgcattcatgccaatgtcatttgtaataatacttgcacacagataaaatttaacaatcaacgacaggggaccaatcaactaaatcatgatacttctattaggttatgatacagccattgaaatatttacaaggtgtcttttattaagaaatttcttaggaagtgaggtaaaatataaacacacaaaatatagtatgtttttagctagccgaaaaagacatacaaaataaatatcaaaggtaatgttacatatgcttatttttgggtagtgaaattgtctgtgattatcactttttattcttccctttcagcatatttgagttttcacagtgtgcatacattgctctatatttgaaaaaaaatcattccttttacacataaacctaaatcatgaaaattgtataaactccatttactttttgcccttttcaatatgataattttaaaataagttaaaagataaactcagttttttatttaatcattaatactctgtcaaaagaattcttagaacactttcctttttaaaggacactattcctaggagctaagataactgaaattatattttggttttaaaaagtcaaaatatttaaagaagtattttaatgtcaaagtcaattagagtactgaaaacttatataaaaaatgaatcatttgcaaaaatatttcctcagttttcatacattttatggcaaaccttcaacacttatttattccagatgctaagattaagacatctggtacagtgtgaggaaacactatttaaaaagaaaaaatacattgaatttagttgtgctagtaaccaaattaagtataagaaatgttataacaaaactgagattgtattacatatatgtacttgtcatttaaattgaggcttgaatcataatggcaccagaattttctgtttccttcatctttgattctgactgtccatgtcttgatcattcaaaaccttgaagataattttaaattcaaattcaaaaccttgagagctgattgtctggttcagaccttcaatctgcttagaaaaatgttgtccaaaaagatatattatttgttgaagagcatatagacagtaagggatagaacagacaacttcatcactggactttttgccctcaaaagatcttgtataaaaatcagacctgcttttaaaataaaagagcatcccatgtttccactgctttttatattgtctttacttacatcatcattaagtcaaaagacataaaacaggttttgattgcagaatagtaacaacaaacgttttcccatattgggcacaagtcttcccttggccttgtaatagccacttaacaggtgtggcaggagtactgttttaaggactaaagattcttacagagtgtgaacaataacaaagatactcagagctctgtgggttttgtttatgttttgctttattttatttaagatttcatacttctgagtgccattttttggtctcaagaagtgaggctaaagttgtgttcaaaatttgctacaactcctcaaagccttttgtgagtgcctccttcagacttgtcaactgagacagttcaccagttataacatgaagtactgtctttactcccagccttcttcctttcccggctttcttccttcttcactcttgtgcagtatagaattgatgttgtgacttgggagactgaaacctccattttgcaaattggtaatatgatttaattatctatattgctgaaagccattgagatacagggtgaatttctaatattcggtaagcatcattcaaatattttatctagatctccctttgttgaagaaggaatacttattaatctggagaagttgtggtagttgttgtttttcaaatcttaattaagcactattgcctttttgtccttaaaagcatatggggagacagttaaatgagttttcaatgaaaagtgagctgatggctcttgtttagtacaaggaaaaccgatgagctgttggaagagttagaagccattaccagagataaggctctaaattaaagctgaactataaacttcaaaattgagtaaggaaaaaaaggatgggagaaccattacctatctaattatgatgcaattcagtggcaagtatgtaaagtttatttcaagtactctaactataccagcagaagttgtcattgcacataattgtttcattagttatgacttgtaaacacatggaaacatgattcaactgccccttttgcagtcaaagaaaagtgtggcttccctgatgaagtgttgattccatattgaggtttgaactgacaaacccagcttatactgtactttgaaatgctccaagcccagatttttatttttttaactacccttgttttaaatatctttcaaaaagacaacgagctaaataaccaatctaatagatagatagtgatttaattaacctcaatgattaaatctgatcagttatttagaatacagtcattcatttcctggacagggaaatgtaaatataatctatagtttttcacagaaataattttgttgttgttgttgagacagagtctcgctcttgcccaggctggagtgcagtggcgcaatctcggctcactgcaagctccggttcccggggttcatgccattctcttatctcagcctcccaagtagctgggactacaggcgcccgccaccaagcccagctaattttttatattttttagtagagacagggtttcaccatgttagccaggatgatctcgatctactgaccttgtgatccgcccacctctgcctcccaaagtgctgagatcacaggcttgagccaccgcatccagccagaaaaaaattcttaagactagtaagaagacagagaggacaggcccaagataaaaagatagagctatacatagggacaaggaggaaacacagtaagtcttcactttagcatcaccctccggaaaaaccctgggctactttcctttgctcattccaggaggatctaatttagagtgtccttctttgctcattgggcgcttgcttccaaggaacgataatggacggaaagagatgtaaccactagcctgggaaatttatcactgaaaaagggcaacaagaacgtggacactaatgcaggaagacaaacaaacccacgcagccaccaagagactagcttcaagaatcaatttattcttcccattctcattcacctcatgggggtcaagacaacttgactttaataatgcgattttcaaaccacttacaaatcacgcaaactgtggtctttctgatacgctcttaggagagggactgtttttttgcacggagggattagcaaatccgactgcatgtatgcttttgaagcagctttaagttttaaaagggaaaggcttccatctactggatactttgagtaataaagactatgagaatccacatgacagatttccttttgtgccggcaatgcataacctggcatgttcacttagaggttttgtaattcttttaaaatacattttgttggaaggacgtagttgttactgaatacgttcagcttttacaaaatacaaagcccacaatatatcacaaaagagagacaaaaggaatatataatttgcccttcttttcatttggaaacaattggatggaacagttaaatacccaacaaagacattctatttgttaagaaaatccacaataagcatagctttaactggaatatgaagatggttgaaacagaatggggtgtttcagtcacctcactttttttcttttctaaaaattgtattacttttaatgagcaaatctcatcttcattagagtctgcctattttgagttcagctacttctatttaatgacacatatttttgctaatatattgcattatatagtcagataagaacacgggtcttttcctgggcatattttgtagatgggatacatttgagctaaatcatgtaatctttgttcaagtcagcacataaagataaaaaatcttttttccagcagatagattttttaaaagaatgtaagaattaatgcctttatttaaaacaaatttagttaataaattttttaaaagtacacagagtacaacattttagtgtctgagtcttaatgaaatctcttaaatttatatagaagtcaaaattaatatcaaaattgtactgaatatcttttataccaaagaaaacaagcaaattacaggttaatagtgtcaacttttaactatgagaatattatggcaaaaaggacaaaactgaaaaatcatgagaatttttttaattcaaactcattaatatgtaggacagtattattcgtggattttccatgtttccataaagtgaggttgaagaaataaagcagaaaaatcttaagacttgccccctaaactatagtaaatatctaaggatttgcagatgcgttctctcagctttataccttcctttataaattaataaatatataatccctcacacctagaaaagactaagtcttgctaaagcagattcctgtcagggttactgtagaacttattttgaatattcttagtaccagaacctggaatataatacaatgttaggatctacctagttcagatatatctttataattctacctgcaggattacctcaaaatagtatttttgaaaacagtgaaatgatgtgctgagaataataggcaatgtaaattgttcatatttaaatatatattagcttggtaagtatatacaacaaatattaaattacagaagatactatgataattcctctttgataaggacctaaatcttttcattcagtgatatcttttctgggttgtctgggttctgttcattgtcttttttgtgaccaagcttttttacacatttatggcccatgctgattgacaatggaaatgtttatttcatttttgcaactgaaaatttcttggcatttacagaagaaagaaaagaaagaggatggaaagaaggcaggcaggtaggaagggagggagggaggaattagccttttctttgcacttgctcctctaactaaatcaagcccagaacttctaaatataacaataaaggaagaaccgctcataggctttagtccatacattcacctcaaattattcaaatgagacttcgctaaagcctaggggagaacacaaaagaaataaaaatgaaaagttacattggcgtagttaatctgacttaaaaataatagttcattcattcatcatttattatctaatatgtcccaggcattcctctaggtcctagggatctagaagtacatgaaacagacaaaatattttttcttcattgtacttcccttctagtatgaagacagacaataaataagattatgatagtagctgaggaaattaatagatcatgaacaggaactgggtgaagaagcaaagtcattttagatagggtagtcagagaaggcttcacagaaagagtttagtgttttgatcatatgatgctgtgacctagaggaaatcaaagctcaatctctaaagacgtgccacccttttggagtgcattcctttttggctggattatcttggctttcttccttgtgactacatttatatgacccttgtccttatggagtgcccccaacctcatatacgctgctcagatttcagacccacagactattttaccttaagttccctgtctggagaacgaacacagagaacgccaattctctgtaaaggaaacacaccacatttaagtacaacccacattcaagaggttcactgggatcgcaggaggaggctgttctgctatacttgctcaatattcagattaagaagtaatcatttatcacaaacgttactgagactccttggttgactatcttaggaatgatttgagatgtgcagccttgtgccttcacttgagacaataaggaaatacgtaactaatattttaagttagggagaaggactcacttccacacctcctgctattaggaaacgcttgagctctaggaaatatatttcaaaaccattatccatcttctctgttgtaggcaactaatgtaatgtagtttacacatgcacagaattgcattttattctgcctatgtttaacaatgcagaccgcagattggttgcaacaatttgctgtcttacaaaagtatgtaacaaatgtgaatttttaagtcacagataatttttcttcgcacccattgaccaacctctcacattcctcccctcccgattctctggtatcgactcttcggctctgcttctattaaattttttttttaaatttcacatatgagtgagattaaccctgatttgatcattatacaacatatatagtattaaaacatcaaatcgtaccccataagtatttacaattacaatgtgtcaatggaaataatataaatatttttaaagatacttttccttgaatgaacaattgatctgcaacattttgtcatgatgcctctactttggcttggattgtcaagactcttctctcttcatttaaaatttgataaactgtgactttaaaatgtttcaggcccagtctcaaggaaatttcctgttacagtacgtaaaatgaaaccataataacggcagtaatttcagaggacatagaatatgtggctagaaatacataatgtgtgcttaataaatgatgctagcccttttaaagcagaaaacaaaactacattaactatgatattaaaaaaactaaatgttatgtcattcgctcatcttagtaaaatggttaaaaattttgtattttcatatgataataaagacatatcatattgactaaggactaccaatatgtcttaataaaataaactcaccttgtaaaatgctatgtagctttctctacttttttttagagccttaaactagattttcataaaccaggttttatcaaatgttcttaacattttcttaatcttactacagactatctttaatagtagatatcatggttatgaagctgtgaatgaaaattaagatattgcttaagtgcaaataattttaaagtaattaatttttggtctattaacattgtctaatagtctcctacatattcaattccttagaaggctgtttgattctcatgtatttaaaacaaactttaaaagtaaattatctagaaactacttaaaatgtaaaaacatactgatgttttaataattaatgagtagtcctataatgtctgtgttcttaaatattgaaactcagcattggtttattgtcaaacagaaatctataattacactatgtagtaactgtacaattttaatgctgttaaaatttacaatgaattctgcaacactgccttgctgagtaactcttaactcagtaaatactgaatcctgggcaggaaaacaattgcaaagttaagtatgcatttaaaaagattaaaggaattaagattactgaaccccatgaaaatattaataaaacacttatcttaatgactgttaagtgaagtagcaaatatcttaatctatgactaaaatcactgaaaattgctttcaaatttttttatctagcagaagaaataaaattaaacttaaatatttctatttatgtctaaaaattcaaaaagtggaataaataagacagtaacctgttattagattatgaaatactttaaagtttttataactgaacaaaaggtatttatcaggtttttgacacgagttaacattctttaactctcactgtgccaaatactttgtatatatcattctatttatttcctcatgataatcccatgaagtattaaaaattatatgttttacccaggagtaaagcaacttataaagggtcatatagctagcatatgatgcacctgaaatttatactcagagggatcattcacatgaatgaaattaataatctaagtctccattgcttcatggttttctccctaatgctttttagattctaggatgacattttggtaaaaggtgatagcatatcttttttaatgtagccttaaatagttatgtgttaatatttccaaaagttcaactcttaaaatatttttaatgtatatattaagaaattaaatgatgacctaaacaaccttatagtcatccttccagaatttttttcttcattttctgggagattttcataagatgaaaaaggacttaatgctatcagcatcaaaagacattccaagtgaaatctgaagacacaaaggggcaacatattgtctatcaatatgtacaaatatgtgtactaaattgccacgaacttggtggctgaaatccagacatatttattatttctcaagagtctagggatggcctagctggggcctctgcttcagggtctctcacatgcctgcaattaatgtgttgatgggggctgcaatctcatctcatggctcaactggggaagaatctgcttccaattttacatgtcagaatttagttccttggagattgtcaggctgaaacctttagtttcttgtctgtttgccagcattttcttatgtggccctctccataaggcagcctacaacatggcagtttgcttcaccaatgccagaaatgcagagagtaaatagagttcctgctaacaagatgtaatataatcatcaaagtgacacctcatcatttttgtcctattttctggattagaagcaagtcataggttctacctacactcaagggcaaggggtcacacctagacataaatatcaggaagtaggggtaatagcctttttagagtctctttgctacagaaaataatgtggaaccaaacaagtaaacaatccttggaaatagccaaataaaaaccactttttatcaataaattcccaaacaattaaaccaggaggcactttctgtaatgctcacccactcttctctatctcatttcccctacctttatatctcagctcaaagatcactttcctcagagaagacttccctgaccaccccttcctgaccaccagtgaatcagttgcctattctttgcatttattctctgtacatctctcaaatacacttgtaatctcacatttgttaatttttgtgtgggctatcttattaaatcctgattaagctgatgaggaaagaaactgtatagaggttttgtggaacattgtatccccatcacctaggacagtgtgtaacataagatgcacaacaaaacgtgagggaaggaacagaggttaaggacactaacctggaagtcaggaaacctagtttccaatgtgggttctttcacttactagctgttctgtttcacccaagtccaatcatatttccaagcctcaggttattcatgtgtgaaaggtcattttctaatgcaaatggttggaactttgatgcaattttttgattttatactgttgttaatagttacatttttattgtattgaaattttttccccagaatcttttggcagctgctgccttcatcttttgaccagtgattttgagatatgcccaaacagtttgcaacaggcaaatttagaggataagagaagtaatgtgagaagcttaaatcaacatttgtaaattacatatattttaagaaacactcctgatgctcttcagagtttgtgcatttgaatgccacagctatgatataattcaaaatgttttcctttcccctagacaaatgaaaacctcaccagaaaacaaactacattacacacatgttgtttcctttcaagatgttggcatcctgccttccccttcagctgcccaatcccctctatggacacagagggtttgttaaattaaatggtagcatagtcctagaccaatgatatcttgaaacaaatataaagctctaaaaaagaagagaggcatgttagaattctctatgtaacagagaactagactattatgtagaagaatattttagcatcacaatagtacagctgacatgcttggcctgctttcatcatgactgaatgttacccttatttagtgattactgagaagttctcataccaagcagtgttaagttcagtttttgaagtgtatcttatgtatgcaataaataactctgcattgttttcagtatcaattctttgacatgaccagtgctagaagaagataaatactgcatgggaaacccaggagcagtatgttactctaccattccctgaagtcatatgtcaaactcatggttattgaaattttcctcatagattgttccacagttaacagtgcacagtgtcctgcgggtaactaatgattctcctgtagccttttccagcttactcatttatagtagtttaggacagaaggggaaaattggttgacagttgaggccatgaatactttttacaattgttctttcaatccacaaataacatgttctcttaaaacgttttttttttttaaatataagtttctactgttcttagtagtgtgtcttaactgagagactgtggttatggaatttgtgtttttctttgttactgtgtggcatttgtgtcaaaatcaccctggtacagaaatgtagataggagaaatggcaagtgcagagaggtggggagcatcagtttcatgtttattagtactttggggttagaaaaatccacgggccaagaccttaaatgatacctctaagagtgcgattctgagacacactggaggtgaggtatagtatgctgctcattgaaaagacatctgagccagagtaagtggttgatttcccacttcgttcatctggtatacaacagaagtacacaatcccagaaaataggctagcctactcttctgttaggagatgatgtacctcctgaggtgcatatacacaagaaaacaacagacataatgggtaacatttagtgagtatttactatgcatgatgcactgtttgagtgttttatatgttaactcatttcataatcatagtagcactcagtaaaaggtgctattattagcactgctgtataaatagaaatctttagatgtcataaagaacattcctgctgaaaaaaaaattatatgccctatgtttacagtctgcctagatagtcaacaattgactattcatagttatttatttccttggtttgagttaacatgttccataatataatctcagatgctccttgagttactaaattgtaacaacaattcacagtagtcttcctgggtcatactgtgttttttctttactaactcataattttaaaacataattagattttcttaactgctttgcaaaacagaatgctgactaaatacagactagaccaatgcactttaataaatattaaaatattactgttatgatattcttttatcaatgaggccaactaatactttgaagccgatttttcataaacttattgctatctatatagctatatctatatacaagagtaatataaaatatatatctgaataagtccaaatcactttttagtaagtgtaggtagtaattctaagacataaaagcaaatatatagagatatatttctaaaacatacatatatatgtgtgtcagagagagagagagaataagacagaagagagggcacatgacagagctctgcaaatagtagttcagctaatatttagagaatgtctactgacaccaggtactgttttaggaactgaatgtaaatacacatatcagcaaatatgtgtttgctaccattgtcttggtttcattaaaaatttgtgattaaaacttgttaatggaagaatttgaaaagtacatggaaggaattatgttttgttcaaaaagatttttctctaatgggatcaatttatgttttgctagtgactaatatttttggttaaatatagaaaatacaacaaagctgtgtttctcaaaatattttcagtggagcactgttgtctcaaattctggaaagcggaaaatgaatctagaaaatgtgaatgcctttggttattcatgatgcactttaccataataaataaagacacctatttaactttgttttacccattctttccattaaaatataagcagattgtaaataattaaagaataaatatatttcatctaatttagactgccatcaattgaaagatcaccattatataatatatctctaagaaaaaattgtttaaactataatgcaaaacttcctttttacctagaattactttgtccctattaaaggaactcttttagacataactaattcaaaaccagcttttaaatcatatgtcattcatgtatatacataaaaatataagcaaaggaattgatcaagcagctttatatttgcaggatgactcttttgaatcacttttcaatgcaaattaactgatgttcatgtgtttcctacccactgtcattctcagtgccattaagaagattgacaatccaggctatcttaaaatcatgattcagtattatgccgaggatattctttcaagtccctgaaaccattcaggaaatttttatcttggtacttttttattttaccagaagggatcaaaggaagctttttcaaacaacaattaagatgcattaaaatgtcccctaatttaaatggccataattatctactgaaactgcagttggctactgattttagagatgggaaaacatatttgcacatgctaaagcagtgacgactacaataaagttgctttctcaccaacagcaatggtaagatatcattgattataaaacatagcactatttcagaaaggttcaaataagatagtatgtggcatataactgaagaaacagttatatctaactagcttcctgcagcactagtgatggatggggcataattttaaagcactttaggaaatattttcgtttgtcagtcaattgcacactgaaatcttctggcttgtatttaattgtcagatcaataaagtaactcattatatatgaattcaagtttgggatcttggatcaatcacactgatgttaggtcagggagaatttgcaacgtgagtcctatcattcaagggatgataattaccatgttctgtacccaggaaaatatttccctttataggtttttcaaacttcctccagtttcatgacccattctagtagagtgaacaagagcatggattttgatattagataaaagtgaacaacatttgaccctacttctgctattttctaagtatacttaataaagttatttaaccattcaaagtcttaattctttcatccttaaaacaagtaacaataataatagataaaaatgctatatagacttaatgagaatgtgtatccaaaagtgcttactatgtagtcgggaacatgaagtcccttaagtaatagtttatctgttgttccagtacttccggtgcctaactaaaccatactactccatggagggatagatgagtgtcctctttcaataatggtccaatatggctttctacattctaaattcttatgatacatgggaagaacatagagggatacctcatcaattataaagttagcaatatttgtcagatataggaagtcagttgctaaggaaaaacacagcttttcctgcttctgagtccacaaaagaaattactcttgagatttctaataaaaacaaaatgcaaaacaatagcaacaacatgtatgataagatagtcaaaggcctcagcataacacaaaatgctggtacaataacaagtttggtgtcactatttttttttgtactgactctcaatatcttaccaagacaccagaaattcagtcttaggtcctgctggttgctgcacagaaattcaatcaccaagacgatgagtattgccagggaagaagacttgaaatcagtgatgcagctgaggagatgggagatagtctcaaattcatctcctcaactgactaaaattaggggtttatatagcaggggaaaaaaatgtaaccatgtgtgggaaaacagaataagggaggagtaaagaagtggagttgatccaaaggaagcaggtggtaagtaaggcaatcatgatgggtcagtggtctgtaatctcattgtccatatgtggtgatctggtaagtttcagttccttgatactatctgggtggcctgatggttggtttcctgagaaagtactcagataagacaaatataactttctcaagtttcaagactgggagggtcagtttttatgcttattcaaaagaaatgataagcatcagttctgtgggacaattggaccagtttcaaatgaaaaccaatatcataattccaaatcctcatttagacttgataggggtcaagataatgctgaaatatacagctatatattagactgagttaattctagataaaattttgatagcctgcagactgttcagtctgtgtttgtctcaatggatatcaaattgttcttttattttaaaagactactgcaaatactcacttttcttatttcccatattctcaatgatcttggaccaagcatttgaatatgagatctttattgtcacactgatctgaagtttgaggtaattgcctagaaaactcagcctcaagacctgctgtaacttttgactgtggatattagagttaaataaattgaaagttgtctgataatcctcttcctgtgtgacagctctgtgcagaagctatgattttgtaaaattcattatctcatttttactccattaaaataaaattgtggtaataatagtaaatgataaattcaacacataatcactatgtattattagttggaatagtcaatcagccagttaatgtagttctgtccactgacatgctaatgagaacttatgagcctgggtaatttgtatggacatagggaatagataaaaaggtagattaagggaatagttttaaatttaaaaacaacaatgataattccaagaaatcgcctaaacctctgaaacaatacagtatcatttatgtacttacaggcttattcatatttttaattgacaagttttaacagtaatcataaggcacaatgtgatgttttgagattacacatacagacacaaacagtatggaataaataaatcaagctaattaacatagccataaccttgcttacctattatttttagtgataatgtcctagttatttgaaaatacacaatgcatcgttgttgactatagtcacctgatgagcaatagatcccaaaacgtgtttctcctatctgaaattttatagtctttgattaataactcctcattcctccctcctcatgcctgtagcctgtggtaaccatcattctattctctacttctgtgagtacaactgtattagaatctacacataagtgaggtcatgtggtatttgtttttctgtgcctggtttatttcacttagcataatgtccttcagcttcattcatgttgtcaaaatgatgggattttcttcctttttaaggctaaatagtgcttcattgcatagaatacaacactctctttatctgttcatctgttgatatacatttaggttgatcccatttcttggctattgtgaataatgctgcagtgaacaagcgagtgcagatatccctttgacatattgatttcatttcctttatataaactcagaagaggaattacagtgtcatgtggtagttctatttttagttttacaaggaagctccataccacttttataatggctgtactaatttatatttccatcaacaatatctaagaattcccatttctccacatcctctccaacatgtgtcttttatatttctgataaaagtcactctaacaggtgcgagacgataccttattgtggctttaatttgcactttcctaatgattagtgatgtaagcatttatttcatgtgtttatgggccatttgaatgtcttcttttgagaaatgtttgttcacgacctttgcccatttttaatcaggtgttctcttgtttttgagttgagttcctcatgtatttcagattttaatcccttatcagatccatggcttacatttgtaggctttctcttcactttgttaattgtttcctttgctgtgcagaagctttttagttggaaaccatcaaacttgtccatttttgcttttgttgcttgtgcatttacagtcaaatcaaacaatttttgtccagacaaatatggactatttctcctgtgttttagtacttttacagtttcagatcttaaatttaaaattttaatccattttgatttgatttttatatttggtataagataagaataagatctaatttcttcttttgcatgtggatctccagctttcccaataccatttacaatttggtatttagatgcaatagaatacaataattgctagctggattaacaatggcttattattatattattttaaaaaggagaaaaatgcagattcttattcatgaagttcataattacaattactgagagtaaataacaaaataaagtccactttctatttggaatttagaaaatatcacaaaaaaattattagcttaaactgtatatactggtctactcctgtaatgtgaatatatatcattaatatgacatacataacaaactttataatcaactgcatagttttgactgttaaaggtaaaaaggagctttatctcaattttttattatttcatatattttaattacaatagctgtataataaacattcatgtggcttaacatttttccatattcttacatagacataattattttaatacgagagttgtattttgtcaaccagatataactttgatttgcttaagcattctttttgttttgttttgtttttgtttttgggggggtggttttttgagatgtggtctcgctctgtcacccaggctggagaacagtggtgccatctcggctcactgcaacctccacctcccgggttcaagtgatactcctgcctcagcctcccaagtagctgggattacaggcacccaccacaactggccagctaattttttggtgtttttagtagagacagggtatcaccatcttggccacgctggtgttgaactcctggcctcaagtgatctgcccacctcggcctccaaaattgctgggattataggcatgagccacagtggccacttaagcattgtttattgaataaaaataatttcccttttaagttatgctgcaatatgtattcttgtgcatgaaattgtaagctttggcatgcattagggtattctttcttcaggtactttgattttagagagacagaactattagacttactagacatctattaggggaagaatttaactgaaataattattatcattgaaatgccaggggtttggtctaaggcccattgcttgcctcacagaagtccaatccctgagacaatgagtattgccagggaagaaggctttaactgggtgctgcaaccagggagacaagagagcagtctcaaatccatatcctcaattgactaaaattagaggtttatatagcagcaaaaaaaatgtaattatgtgtagggaaaacaggaattagtgaggggtattaaagaggagctggtcaacaggaagcagttggttggtttaggcagtcatgatgggtgagggggtctggtgtctcactgtccagatgcagtgatctggtaagtttcagttccttcaaaatgtctgggtggcctgatagttgatttcctaagaaaggaacttggataagacaaatacaattttctcaagttttaagactgagagggtgaatttctatgtttatataaaaaaatcataaatatcagttctatgggacagttgagccagtgtcattatgatcttccatctaatatctatttaaaatttaaaacatgatttctctaaagagtgaatttaatactataatgcaatagacttactatgaataaaagacagatttttttatacttaaattcagggtgcatgtacagatttgttacatgagtaaacttgtgtcaaggaggtttgttgtacagattattttatcacctgggtattaaccctagtacccattagttatttttcctgatactctttctcctcccaccctccatcctccaatagactacagtgtgtattgttcccctctatgtgtccacatgtcctcatgagttaactcccacttataagtgagagcacgtggtatgtggttttctgttcctgtattagtttgctaaggataatggcttccagctccatccatgtccctgcaaaggacatgatctcgttcttttttatggctgcatagtattccatggtgtatatataccacatttgctttatctagtctatcattgatggacatttagctggattccatgaaaagacagcttatttaaaaaaaataggagcccataaattttatcatttacctattaatgaaacctgcaaacctggaattaattaaaatactcttttgttggtactcattatgcatctttatttcattgtcaaagcctttacatggcttttgcaagttccattgaaagacttgccttaaaaacttataaatttttgccacagcgtgtgtcaccttctaatgtatttactgtttatttaggtctttctccagtagaatataaactccatggaggaagataattttgttttgttcacagatatatcccaagtgcctagaaaagtcccttgtacagagcttgaccacagtaaatatctgttaccttaatcttggcttggcctctgctgtctatctttagatagtcttctcttttacgctcacactctatatctttccatatgtggatttatcttacttctatattggtgtcactttcataggcctttgttgtatggtagccccaaaaactccaggcttaactcatctatacagctacccagttccagaggaaatagagtttcaactttctaatagccctagtgtattctcaagggtatgcttttattaggctgactggtttatttgcccattcctgagtcagtcattgttatctgggttatatgtaaggaattgaaatagaatgctctagttattttgggtgctaatcaaaatctggactgagcaaaagcaggatcccttggagcttgttagaaatatggaccctaaggcccccactccagaccaactgaatcaaattgcatattaactagattttctggtgatgtgcctttagtctgtgctcacagatggaactggaagagtggggaaggcaatgaaaccagccccatccaagctgaaagtgaagtgggagtggtttcccagagaaactcaagtgcttttaccagagggcagaatggatgtcaggcgtgcaaaacaacagctatccaatgcaatatatgatgtgtattaagcaattattatattccagtcattgtactaaaccttttccaggcattatttatttagtagtcacaatatcttgtaagatattatcaggtaggataccttatccttcaaaaaagataactcatcatccaaagtttttgttgagaaggcagtgagcaaagtgatctgaaatatgatatcagatagtaataagtgccatggaaaaaaattaagcacgatagagggataaagacagacctaggaagatgagagaaagtgatcaattttgataggaaggtcagaataaacctgaagaagtaaattttcagcaaagacttggaccaagtaaagaacaactcatgaaagttgcagggtaacaccattacagacagaaaaaaagaagtataaagccttgaattgttgaattatgaatgaacgtgggatgtttgaagaaatgtaaagaatgaaaaaaagtggggctagaatgaagatgttactgaaacacaggggttctgtctgtgtcctgctgcttgctgcactggaagtcaatcaccaagacaaccagtatttacagggaagaaggctttaataggttgctgcagccaaggagatgggaaatcagtctcaaattcatctcttcaactgaccaaaattaggggttgatgtagcagggaagaaatgtaaccatgtatgggaaactaggaattagggataaggaagaggaattgatcaacaagaaacaggtggttaggcaatcatgacaggtgagggggtctggtgtctcactgtccagatgcggtgatctggtaagtttcagttcctttatattatctggttggtttcctgagaaaggaacttagatgagacaaatgtaattttctcaagtttcaagaccaggagggccattctttcatgtttattcaaaagaaaccataaacatcacttctgtgggacaattgggctggtttcaaagtgagtataaatgaattcaaaaagccagccaagagctattttctaaaggatcttcaggcaatggttaagacagattcaattattcttagtgttatggaaaatcacggtacacttttggtcaggggagtaacatgatttgatttgtattttaaatatattgactaaggaacaggcaatagtgaataaaatataggtagaggaatgtaaaatgttttggggctagttaggagactattgcaatgctagtgtaagcaagagataggagaagttaggaccaggatggtaacagtagagtggctgaggatatattgtgaagtagagccaacaggaattcctaatgagttaaaaatgtatatgtgcgagagaaagaaaattatttgtttttccttgagaaaatcagtggatatttgtgctagatactgaaatgaagaaccttggagatggagcaagttggagaaacaaatttttgacttgtcaaatttgagatgcttagtatagatcccagtaaaattattgggtaaacaattggataacctactttgaagaggtttgagttgcagataagagtttggggaacaagtaagattacatatcaaaccatggatctgaataatctaattcaggctctacagtcactaaatcatacagcacaagaaaagtctctccatcttgtagctgcacccactgggatacaagtcctcctcagtccctgtggcaaaggaaaagaaagctctcatacttgctttcctatctttaaaatcagaagtgacataacccctttctctcacagtttgttggccaggaccagttagatgtccttacctaactgcagggacctgagaaatgtggaggagtacatggagtgtttgtgaggactgttgtctcttaatatgtctcacttctaagaagaaaaacatggattcagagagaaaaagccattctcaccaaaatgttaagatagcccaccatatttttttgtacatttctaaaggtaatttagcataattatctaggattagaacaaaagcaagttgcagtggaaatgccagggggcggcttagaggtggcaggataagaaggcttttgctttattcagtaatctctataattccccattagccactttttgccaaatctgaagtggacaattaatgttttctctgacctcatataaaatggtatgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaggtatgcaaatgaaactttaaattttcatttcaatcagataactgctcagaaaaaccttctaggactttatcttttagagcagaggttggccactgtgacccatgtgccagaaccagctcactgtccattttttaatgacccaagatctgattttaagtacttgaggaaaagtcaaaagaatagtatttcatgacgtgaaaattatgtgaaattcatatttcattgtccataaataaagttttattggaaaacacatgcacaaagaaacccttctaggaagatgttatggagccagaactaccaaatcttaacatgatgaaaaagggaggatgttgatattaaataagccacctcaattaaatccacccacctcaaaaatgaaaacagaacagtaaaattgactattgaattaagtcctctgaagatacagtgttttgcctccccaccaggcacaatgtcatctctttatatgattttgaggaaaatgtattcaattatttcaactgtaataatacttaacataatgagaaattcttctagtgatttatttttgtaaatactaaattgttttgagcttcttattttgaaggttgcattccggattggaagttctgaatagaattatttcgaaagcaaatatttatctgtttaaaaagcccaaagaccttgttttttctgcccaaacaccagctaggaaaatcaatattttctcttggaaggaaatggtttggctgcttcagcatcagaatgctttctaataacactatggcatttaattttgaaaaaacaaaagttctgaagagacaagaaggtcggagctagtgaatgatgagttttgagtgttgctgctttggaaaatagtggcttggtaatggcattagttaaagacatttagattgtctaaacacttgctctattttagacaacaattggctggctttgttacttggttgggatagaatatcctaaatactaggccattttgtgccagcatgttgcatagtggccttaaagaagaaagttaaacattgaaatattttcagaatattctaagaataattgctgtcttgtcacagttattacttatttcaatcaaatgccaatattaatattgagcaaaccaagttgtcgtaaaattttttataaaaattagtagcattattattcctcaactagaaaacattcttttctgattttcagtggaaatattcatttaaatatcaaatattctattatgtgaaataaaattaatcatttttcatatatacatgtgaatatatttctgttcatttgtttgttagtttctttacacttagatatttgctaactttttcaaggacaatggtagcttagaataactcaataaatcaataaaaattaagtttatggtaactagatagaagttcaagaaaaagaacatatgtacagtctattacgtgaattattctatataaatttcgtataaaatctacaggtggtgaataagtgactctatagggaaagtgtgaatattaacaaaaacattggcactactagaattttttattaaggagaaacagacatattacacagctcagttaagctttgattatgagatactaaataccaatttacatttagttaattaattattcaatctaagtagtacaagtacttggtgataaatatttgtatttgaaaagtcataaccaatgggagaagtgttatttatatctatttaatgtactaattcgatggtagtaaaaatccagtggagtagcagctgcatatgcaattgaatttgctggaattatgaagaagaaaactgatagcaaagtaaatgtagtaaaacagtactaaaacaaaaatagcacaaactgatttgtgtttctctgaaaaattccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgaggtatgaattatttattttggttaagttataaatatattttgcaaatggagcaatttctaaggagctcagtattttttatgttatgaaaatgctgtaagggatttttaattagatctgttttaaacaacttctcatatttcaaggaccatgaagtcttcatcataaggaatcataaaaatgagcagaaattttaacattgaacaaaaaaaaaatttttttaacagttctaaagcttttggtcatttacgttcttaaaatttactgtgtaccccaaacaccttttgttcatgtgggttacaactgttattaatatttactgtatttaaattaaaactgagaactttaaaacccattttttactaattaaacgttatataataaacaattacatgttaatgtaagtaacatatttttgaaaagttaatatattttttccaagcaaaatcaagtaatgataagagagtaccattgattgtatttttgtaaattgcattaatgtctggcttaatagaagatagctggattgtcatatgtgcttcggtattccatctattgctgcaatacaaggcagtctattacaatagcctctagaaaactcttatacactcaggagaatgtgaaagtgaaaactgcaagtaatatcttggtactataacaaaagtggtattgacgttgtagacactctgagaaccattgatctgcaccattcttttctacatatctattttatcttgaaatacaaaaatgacttcattataactatacaaactgtatataatgtatgtataatatataatatattcatactatagataattatatataatatattcctgtattcatctcatagattgatgattatatataatatattcctatatagcatatatatctcaattggtcaaaacaagaattatatttcctttatgaattatatcctccatattgataattttccactgaataggaatcaaagctaccttaatattggttgtgattaaagcatttcaagagcaataaataggccgggagcagtggttcacgactgtaatcccagcacttcgggaggccaaggcaggcggatcatgaggccaggagatcgacaccatcctggctaacacagtgaaaccccgtctctactaaaaatacaaaaaaaaacttagccaggcgtggtggcaggcacctgtagtcccagctactcgggaggctgaggcaggagaatggtgtgcacccaggaggtggagcttgcaatgagccgagatcgcgccattgcactccagcctgggcgacagagtgagactccaacgacaacaaaaataaaagcaataaatatgcacttaggaaataattatcaagtaaacatattcttagatttaaaatgccattgttgtagaccataatggtagaatatctgaaaatgtatatggtttaatctaatacttttttgggtcatctgccttaatgctctgtaactttataaacatatcttacttacaattaactagaaaaaatgaaagaaaaaaatacttgaggtgactggaaccctagctgaatcgtttttaatgactgatttaagtgccatattcatgccttattgtccaagtctccacttcctcattagccatgtaaatatctctctatagagcttgatttacatatatttaactttcatctgaataatgtagtgaaaaatttcatgtgtaatagcattgattttaccactttctaagtgtatgactttagactagtcacttagtcccgtacctcaaagtatttttttgtttgtttttattggagaaggaggtattgttgctatcattttcaaatgtgtaacatcctcatgttggcactgatctcacagggatttatatttaatgcagaaaatatactacagtgctttttaaaatagaatagtctttgcatgttagttattacaaatcactgaagatctctgataaaatatttaatacccttatcactttattgaaaatttgtttgaacattcatgaacctgactatatcctcagaagaaaggagtttttctgttcttcttataaaatgtttctgtcactgttgtcagtggacccaaatcattagtaaacatcgattcccttttctaaaaggaggaatgaccaagggctataacaggacagaaatgagcaaagaggacttttggaaatcctctggggccaccaaggtgactcctgagaaagactcagggctctgtaacagaattagatgtttagttccaagttaaaaatccaattttatgctgtcctgcactatatcaaggaaacctaattcactttctaaaatgtaaaaataaaatatagtgtgggcaaattcctttgtacaaactactgatttcaaattagctatcttctaaatggatcaggtgaccatattttaatctgtagaaatactttaggaaaagattttaaagagaggaattgagcctttcatagcatctaaaagaggcagtatggtgtattgaaaacattccagcccctgaagtcaagcataggagggttcaaatcctagccttacagctttcattttgagtggcattaagtatcctctctactacctctgtcaacagaataaagataataatactgggttatagtgatgactgaagacataaaacatctagcccaatgcctggcaagaatagtagcctaccagtagttacacttattatatctaccatttattgatttcctatgccaacagttattctaggtgctttagatgaattacgtagaaattagaacaactttcatgacttggattttattatcgcagggttaataaggaaactgacacacagaaagtttatgtgcttggcctataggtcacacagctagttaactattgaagttaggataaattacgtgctagtccaacactaaggctcactttttcttataactagaaggagaaatagatgattttattatattttaatcattcaaaatgtttttattaaataactaagagcatgaagctgagtgtgttggcaggtgcccatggtcacagctattcaagtggctgaggcagtagtatggcttgagtccaggagttcaagaccagctgagtaacatagtgagaacccatctctatttaataaaaataaaaaaagaacttgagctatgtcttagtccattagggctgctataccaaaataccttagattgggtaatttataaataatataaatttatttgtcatagttctggagattaggaagtccaagatcaaggtgccaaccgatttagtgtctgataaaggcttctaggatggcatgttgtcactaagtcctcatatggaaaaagaggcaaatgatatatcctcacatggacaaaggggcaggacagctcccttcaacctcttttataagggcactaatcccattcataaggatgaagccctcatgacttacacacttcctaaaagtctccacctcttgaatcttctgattcatagttagacatgttatctcttgggccactggtcctcttggctgcacctcttaataccactacaatggggattagatttcaccatgaattttggataaaggcattcagaccatatcaaactaaaccttttgttatatgttgaaaatacaaagtcaaataaggaaagacctttactcttaagcctttctaccaaaatagggatgcagaggtgggtagggcaagagagaatcaaacaagtaaagaaattcagtagaagtaaaagatgccctgcatgggttatatggtataacggctgtttaaaaaacctgatacatttaacagataaattaagttctgtgctttctggagtattaatgtactgtagttttccactttaaaactagccttaaagaaatgcaatccagcatctgtttccatggaaacagaaggacaaattcaccaagcactacctcccaattcaattttgcatggccacgtatacataatttaagatggacattttgataatgagttagagttgaactgttaatgaacaacagtcattttctaaagctttttccttcttactgcctgttattaacctttattggaaaaatgtaaaaaggtaatctttccttatgtataaggcactttctcttaaataattagagtcccaaagcaatatcaggtgttcaagctacttgccatcaaaacaagaacaatatttctttgcagtatattcatttgtacttctcactgaatttgaaatgaaattgggtggctttaacaatttatatatttttaacttcaatatttttcaaactctatttgatattgctgtgtattggtgaatataaatgtttccttgtcaatttccttttataactttccttgctgtattggaatatatagaggcaaatatggtattcagtttttctattatataccatcaccaaagtcaatagttattgatatcagatatctgtatcttaatttattttatgtttgcatcttactcaagtaattgaaatattactttatccagcccatgaattacatgcagtttccaatgggaagttaaaagctgtgcaattgctttgaactaaaacctttaagtaagttaatgaagcatgtgtcttttagactcagtaagcagatcataatggaataaggaagttgagctctttgcagcattaaattctctcttaactagccctgaagcttatgtagatttaacatgctcggttctgatcttgtaaatttaagtgtaagattgaaagaaatggcattctaaaatagaatgtctcagcccaaatttttgggttatgacaggctttctgaaaaaaaaatacattgtgaactaaaattgaacacaatctgagggcaaatgaaggagatgaggatttcaggagccaagtgacaactcttggtgcttaaaatttgcatttgcatgttgctttgaagatgtttcgacattagcatatgcattttgtattgtgtacttaacctcggggtttctttttcctcttgtatcctttagccatagtaagtagttaaagttcttgcctatattggtattgtatgccttaaatattgctgaagagcaaatttacataatggaaaatagacatccatgaagctgctaggctgcagagattaagggtaaaatcagttactgccaaatgcagaagctaaaacgcttaaaagtttaccctttctgttggtaatcagatctatttatagattcacagtcttcttggccctttaataggatgaccagcaagaaagccttattttaggtgacttacgtaaatgcggacatttttctgttcattttatttccaaaattcttggggactcagtagctaatttttatcccagggtttctgaatatgtgtatgtgtaaggagaatatgtcaccctttattggatggctaccttaaagtatgttgggctaggcaactcacctgtgaacaaagtgagctatttttattacttgaaaatattgtatttttttaacttcatatttctaataaactaaaattcattctaattttattacttaaatgtgtattggcagaaacagctgcaacaaactatatgccagtttggcatttattcaattctctcaggattttggttgtcactgtttttgttatccaccaaataaattaaattgtttattttgctatgttctttacttttggggggaagggatttcagatatcagataacaataatttttgaatctcacagtcattaatcaaggaccttctaaatccagttctccataagtgaagtcaacttgaattgtttcagtatacagattttgttctcatctttctgatttattcacaattagattaaacagaaaatatgctttaaatgcatatccacaagagcaatcatattatggaaatattaacattaagctctggaattcactgcaaatgtgcttatttctgtctttacaaagaaaagagaaaacaaatgaggttgacatttgtaaaataatgataaaaaataatatgcaattgaaggataaacgtatgttgggataattaaagtaaaataatgctagtttaagtttagactgtcttatctttagaatggattttctatgagtttttaaaacggaaagattggtggtgggggcgtgggcagtatatatctctctcttttagaaatggaattctcattgctacttgcttttacattccagcagagggagcaaaagctagtgaacaaattatataagtgatacgaacactaccaatgatgctgcaatgcacagaaacatttagaaaaagtcttgctgatttcaaacatcaaaacacaagggggaaaaatgccctcaagtttgtgtcattaagaattgttttcaagcaataaaagattatgtgtaaacatagaaatctcaaagcagacagccaattaaagttaaaactatcttggccttgtgccatatattcaaacatatgtaacatatgaatgagtcaaaaaagtttaccagatcttagagctaccagtgtgcgctactattttgattcaagttctggaacagactttgtgaagaatttttaatggataaagttctttagttgttggttgctttgatttttctcaggattaatgacatgaccaagccattgttactgtcaggtaatatggtaccgttgacaaaattgcatcttttctgaaattttacttcttcccttgaacaacattctttgtgagtatatatttgaggtctcaaggtgttcttagaaaagttctgattttaaaattatacatgatcatcctaaatttgattatcctttacatctcaaaagatgagatccatagtttcaactctcccatatgctagtattgagatacatgttaagatttgtttgttaagaattgttagaaaacaccagtgaccatttttgtattttgaagacaatatagcagatgcctacagggttgggctcgctcactcgggaacaatttatgtgcttctatctgccccctaggtgtgcatggctttaaaaaaaatctgaatattttaggcctagtgataaaaacctttcagattttaggccaggcatggtggtttacgcctgtaacctagcactttgggaggccgaggcaggcggatcacttgagatcaggagtttgagaccagcctggccagcatggtaaaaccgcatttctattacaaatacaaaaattaggcagttgtgatggaattccatgcctgtagtcccagctaattgggagactgagacatgaaaatcacttgaacctgggagttggaggttgcagtgatctgagatcacactgctgcaccccagcctgggtgacagagctggactccgtctcaaaaaaaaaaacaaaaacgaaaaaaaaagctttcagatattgtctctatcccaggtgatatgtccctcttatttgtttaagatggcaactgatatcctgatttcctgacactctgtcctccacactgcttatctctcaggtcaccctggacatagatagaaattatttgcctgacctcagctcatcaggatggcactaagcataaagaatactttgtttttaggctttttgacctggtcccccaggcctaataccaggttgcctttatgtatcttttttcatgtgtcttcacctgttgtctagataacctctggttagctctgtttaagcagaactgagtcctcccttgctccttccaggcctccgttctaacaaacactgcctccctgtctggaagtcaggactggcaattcccagactccatagaatacctttacgttttgttttggcaaattagttaacctctctgtatcttaatgtttttgtttgtaaaacgggagtaataggttggcacatacaattcaaatagtttctaatttatattattattatcatcatattggaggtggtagtggttgtctctcttttctccctgtggcaggtttcctaaaccattgactcctgtctattgctattctcccagattctacatccagccagacttgacttcagttcctattttgtatccacttagcacctgctgcattctgaaggacaagtaatattacacatccacaaactacaaaaccacattgaatgtggagtagttagaatgtgccagaaataggataggcttcttttcatgcagtccccaagataagtctattctggaattctggaaaaattggtggcagcaatgacattatgtgtgaatctctgaattttcccattaaaacagaaaacgactagaacagcaaaacttaaaagaatgataaacaattttgacaacaaatttaggtggcaaagtgttctcacagattctcaaatatgagctgacattgtcatgacccagatgatactacaatttttgtaggagacaacagaggaaagcaatgaggtatttgatggaaatgaggtcaggataacacccaattttctaatagatactcatgagaaattgtttcaggccaattggataatagtagctgaaaatgggagaagtactttgcaggtgagaaaaaaaactcctctctaatatctgaagggtctgaacagtctgcagtctgtgaattcttgaaactcactagctgaagctccttctcagaagacactttggggaataaagcccaactagagtgggaggaaaaggaaatgaatggtccagattaaaatgggtgaggtaaatggggtcaggaggtctcaagaaatagaagggtaatttttttttttaacacttcaaaaactacagaaaaaggtgttccatatttgtgaaaatagaaatggtcttttgatcaatcatttccccttaaaagactaggaaaattgatcttatgcaaaaaaggaaagaaggaaggaagaacaaaaggaagagagaaaagaaaaactagaaaagcatgactgatgtaagaaaaagatagtaagaagtagaatggtatctctgcaaacaatgcaagcacaccagtactttatgctcataagacagaggaaaagtgtaatctaatatttcaaaagatgctaaaataaatgctctaaatgatagaatatagaaaagaacaacataaatttagaaaaactgaaatgtgcaagtataatgcaggaaagaattagaaatcaaagactaaatcatttcagaaatgaaggccaaacttgtaagaacacatgagtgaataataccgagagcatgccataagaattttagaaaagaaaaaggagcaactaaaaatataaaaattggaaactaaattgttcaattgaaagtgacacatatagaagataagcaacaagaccaaaaatattaggatttcctaaagagaaaaaccaatgaaataaaatgaacattaataactataggcagggtgcagtggctcacacctgtaatcccagcaccttgggaggatgaggctggtggattacctgaggtcaggatttcgagaccagcctgaccaatatgatgtaaccccatctcttctaaaaaaaaaaaaaaaaaaatttgaccaggtgtgatggtgggcacctgtaatcccagctacttgggaagctgaggcagagaattgccaccactgcactccagcctgggcgacagagtgagactgtatctcgaaaaataaaataatgactataattccgggaaacttttctgaaaataaaattgcaacgatattgtgaaaaggaacactacatccctgcgagagtgatccataatgagtaatgtcaagatacattgtaggaaatctcccaaacttaaaagataaaaaaatcagtttggcttcgagggaaatagatacttgtaagaattaagagggggaaaatcccagattgtcatcagagttttcaaaggaatcctttactctggaagtaaatggagtaacatttaaaaggtagtcaagtttggtgagtcatggattttagatctatcaaagtgattttcaagtatagcagccacagatatatttatcaacatgcaagaactcaagactattgttcctggtaaatagaaatagcatttgcccactcgttcaggcccaaagcttggcatgtttcttgatgtctttatttgtcttataactcacattcgattcaatggaaagttccagtggctctaccttcaaaatatatctgaaattggaccttccacccccattgttattctgttaatcaccatcatctcttgctggcatgactacagtggccttcttccttgtttctctgcttccagtctttcctccctctaatctgctctttgcacagcagccacaataagctactattataccatgcctatgctaaaactctcatgattccttacattacttagtctgggatacctctctaacctgccccttgctcactgcagtggtggtacaaggctagtccattatttcactcagtactgtccaactacagggagcatccatttgctgttcccctgcccaaaatgtccttccatagatgaaaatatggttgctctcctcttcattaaacgtcttttcaagtgtctttattccaactgacctttcctttctaaaatagtaccatctccttcactttatctacccttacttactgtgctttatatttcttcacaggacttcttgattttctgacatattacaaatctatttatttgttgctctcttcccttctaaaacataagctttatgaaggaagagactgtgtttattttgttcctttctgtctcctcagcacctcaggtagtgcctggtatgagatatacattttcctgatactactactcaattgaataaatgaattcacaagaggtgttacatactaaaacattaaagtgttatcttttgtagaaaatagatcaataataggttgttactgaaggcaaaatattttggagccattcttaaaggtatttcttaatttgtcaaagagtaagagggcatgcatctccgataagtccctttccagtaccactgtcagagtatgtactaggctgaatatggctttgaattttctgctttccagcagagagagaaagccttacaaacaattcaagctgtaacccctgtaattattaattagtgcctattcaagtaccatgtacctagcagagattcttctaatcagattgcataccttacatctaaaaatgaattcgtcattttgtgagatatgtatttctctaagtataatggcattatactgtcctacactcttttaggaactaaatagcaataatgtataatcttattttcaagaaatcttccttttatgaaaagtcaataaaatctgatgtaagggatttaaaaataattcaacttatataatttgatcagactatgtgcaacctataccatcctatttactacatcatactacaatttatcagttgttaccttccttaatcctctccagctgcaggtcctgaaaggtcttttgcctataggttcaatcccttctagtgtctggaccacctgaaatcagattgagaatatatttcagccctatatgaacaggtaccgggttttgcttctagaagcccgtgccctttccttgtaatattcagtgtgtgttttgtcttttttaatgggttgctgctcagatttttttatgaaaacacatataactctgctctaaatctcagccccttgaaacagggcttgatgactctgtccagttttttctaacatttaccaaatgggaattctgatccatactattctcagttattgatgggggccttaatgcaagtcataccactttccccaactccaggtactagtacttggccatgaggttctgcaccacagaaaaagtgaattgtataaaccaaattcatcctctatatgtttatgtagtaagtttcctgtcttattcattagccaatgtgaggaaacatgtactcagagcatagataagtaaatatatgtgtccaataattctaccaactgaacagtaaaatatgcatgtctatggttcggagatacaaacttttcaaaagcagagtggacaagcataaatacatacttggggttgagactaagtaaaaatctgaaatatcccatttattagaaggttgaaggtttttttcttttttgcattcatttgttcttgattcagtgagattagtatctttaaagtcaattattggttttgtaattacatttggcacaaatatgtattaactttatgttaattatgggactaatgccatgtttgaatgtaaaccaagaactttatgtctgtagtcagcaattcaatcttgcttttgaggaatttgtaatgtgaaatcactgtttagcattgtaatagctttccttagggtcaagcacttcccaataagtttgacattaggcatgaaagaagatgcatgaaaatgttttactcacagatataaacagtgtaatctttattaacacacagaatggaacatacagtaatgaagcaatctaaaaagaacataaatttcaatatttagccaatttgtttttatttccttccatgcaatagtataggagttcaagaatagtcaatggttatttgagtggaatatgaaaagtgtgtcctaattttcagaggatttggggaagaattcctaattcataatatgcagctgcttccttcttctatgatactatgctataaacagggaatgtttcttgattagatgccaatgccaattctgttcaaaaacttcaggaggagtttagaaatgtatacaggttaagaatggacactgaaaaagacaaatatttaaagtaatatgtttttcttggagaaattttcttatgaagttgtattattcagttaacaatagatagtaacatgagaaggatttgatgacttaaataactgtctgatttatgttttatccccccccttttgtgtgtttcctttagataagaaatgttgaaaccaatcagtgtttagacaacatgggccgcaaggaaaatgaaaaagtgggtatattcaactgtcatggtatgggaggaaatcaggtaaactctccctttttatcagcttcatgttttagagggaaaatattgttaaaactatcagtggagaccatggctcacatgttaataactataaactgagcttaataaataaatgtacactcaaatctagaactaatttggctattttattgtcccaaggatcttaaaggagagctgaaaaattaaaataaaaagagcaacactttcagtgtgcctacagttaatgaagatatccaaatattttagacacatctcattttatcatgtattagcaaatgagaggagtacattttattctattaactgaatatagaaaataattcctcaacatctgtgatgttttcccaatggttatttttatccatctcttttcagatttttatgtatgttatgatttttaagagcttttgaagtttaataaaatgtttaagtatatagttcagtgttgaaagctgactaaaagtcttagacagcctttcttgtgtgtgacaagagttcttgtgctcttcttaagcattggaaaaaagctttgcatggtgggccacatggaggctatttggctgtgagtcttcaggacagagctattttactgccatggccactttgagaggtagaatttggagttcctgggaactataccaacaaagcagagtttgaggtagctaatcctctgtaaacaagttatctacagaagtttaggagaaccaaaagttttttatccagaggtagaatttctgagttagtgtgaaccgaggttgcaaaagttatcctgtccagcacaattatggttatatttgtgtcaagatttattacaaaaatacttgttgattcttgtactataaagaagaaaatgaactctgttgagttttggcgcaccatacttcaaacagggccggtgttatttaatggagaacattaaaaggaagtttctcccttaaaaattcttaatttaaaaaatcctaattagtgttccaaactgtcaatttgagcaagaaaatatttaaaccaaatttctaaattacagcatgggaaattgaccttatggaggaagaggatagaaacaacataggcagactaatgacaaagcattcagaaatgattccatttattgtttcactgattcataatgaatgtgacaggcctctactgccaaaaaccaatgaagtcctgatgaattcagctggaaacaacaaaatgcttaactataagaggactaaatgtgtgagggtttaattttctcacataataaaaattctgacatttgtttaggacctcaatgatttcataaagaaaccaaaaactttatgtctttccattctttagtgtttagagttaacttttatcatcagctggtcagaagaggactgctgaaattccagacatcatatccacattcaaggcaggaatatcaaagtcagggaagaactgcaatagccatatctgtttttcttttaggaaaagcaaaagccttcctagaggctctacacgtctcagtgtatctctctttaggtaaaaatgtgttacttggacatccctagtacaacaaaacactgaatatttaaccccacactcacaagtagctgcttctcacagttcatttaccaagatattggggagacatttagaagtgccagccataatctgtttgaacaacttatggcaaaaaaaatcagctaattatctgctccataatttcatacagaatttaaagaaacactacttatgaaatctctctcattctattgcttatgaaaataagaaaggtaccccagatgaattctctacatagaatcattacagtgccatattaaaaattactttattcatctgcacgttttcaaatacccagaaataagctatctcactctactgcaaacttcttgctggcagtcctatatcttactcctgttttcatacccagcacctgctgcagtcttggaacatggtgagcacctaacgaatactaggcaagtaaatagatgaaagattgtattgccagaacagtagatttgtaccttagaactttgtagacattgccaagaaataatgagctgttattttcatagtaactaaaagtatataaaaacagctcagggattcataaagaaagtgatcaaataataataagcataaaatctatccctacttttattctaatgtgctctacaagatcaatttaataacaagataaaaattaaaaccattatttttccatctacatacttaattgcacatacacacacacacacacacacacacacacacacacacacacacaaatgtttttggagccctttttgttaaaacacaaacaatggaaacaattcagtatttaccaagaggggaatggttaaataaagcatggtatacgcacagtatagaaagctgtataccatcaaaatgactgagggaggtctgcatgtgtgtcactagaacttcaaaagagaaaaacaatccagacaacttattttcaataatctcatttatgaaaaaatatttgaacaatatatagtatctgtatatttatatggatgctatgtaatctattacaaatctataaaaatctatctggaatatagattgtatctggcgagtggatatctggaaagaagactgagttggaaaagaaattttcctttttaccgcacatttttctgcatacagtagtacatgtatttccttcataattaaataagaatggggaaatttaaactattgagactagaagaacattgttgtgttgcattaccctgatctgattaattgggtaacttatggcaagttacataatatttttgagctttgatattgattgtccataaaatgaacaaaagatttcattcaaattttttctaacactaggaaaattcattaaaaaaattaacactaaacatggcacatactaaacatgcaatgtgtattgatccattgccattaattagcccctttacttgttatttctattgatgttgttaattctcttatttctgaagttaaaaaatgttcgttcagtggctaatgtcacaagcaagataaaagcacaacacttaatttggtattgttgatttcaaaacgatgaacaacctctcctgtaactctaacaaatacagattatggaaaaatttaaccatcatataaaactcaattattatgaattctgctctgatggaattcaatatttctaagataattaatactaggaacctgtttcaggttttgtctttctcactttaataaaaaacagattttagaattttattctcagaattaccctccctggttttattgctattcttttatgttaccatggaagcagcaattatttttatggttatttagttttgactgttttataagtagcccccaacccataaaaatcactcaagcttctctctcttgcttttacacaaaaatcataacaaatgttaaaatccttttttaacttagttacatttctaaaaaaaggtattttttttttgtttgtcaacaattataccttaaccatttctccttgcataggagttttgatagtttaggggttttttaaggccttggaaacatcaggaagaaacttacttttcagtagttgttagaaataattttcttaaacactcagatttcccagcaaaatctaaatggagttaatgaaagtttttgtagcaggaatactgcaaaagctaacaactggagaattattattcaattcaacatgaccattttgaagtgctctttttttaaagccttataaataaaaactgtcttactcaaagaataacaaaattcagcactccatttatatctattcttgcaatgatttattttcattgtcaagcaacttcatgataatcattaacactttgaaaagaataagaataatttgattaacttgaatataaacttttacaagtgaaagacagaagttacaatttactgaaataaagtatagcagttgtgagagtgtcttctctgtacttctgaaagatggcatggattcctggaagcacttccatgtcccgtacaatgttaatgactcagatttacatgtacagccccaacctctctcctgagctctagaatctatagccagttaattatcgttaatgtctgcagacatctcaaacccacctgtttccaaactgaactcatttcctttcctttcacagagtcatccaaaatggaaacctaacatagaaacatacttctgaagtccgattagtcaccaaatcccaacacttctatggaaaaatgtccctacatcttagtccttttataaccaggatctctgcctttgttctagcctatatctacttttacccatatggatttaaaacctcattattttcataactcataattcatgctacattagtttaacatctcattaaatattcagcagctttccactgcccaaagaataaaagccaaattctttcctatgatatacaaaacccctcataattgtatccccatctggttttccagcctgatctaccttgatgtcccatcggtctcctgtgctctagacatacgtctcatgatttctcattccttgaatgctttcagtgttttcctatcctagcagttcacttacactgttctctgaaattgagctgttggctacactctgctccactaaaaaacttaagacacactcactgttgaaaacccgataatttagcttctcatttgctagctattcattagcaactccttaacctaaacaggacacatttttaatggataaactataattgatttattcattgttttattgtttaacatacaatatttataaaagttcattgttataaaccaggcccatcaatttccttgtagctaaaatctggcaagcgccaatatttacttctttagaaatatctctagaagtacatttgctacaggacacatttttaatggataagctataatttatttattcttttattgtttaacatacaatatttgtaaatgttcagtattataaaccaagcctatcaatttccttgtagctaaaatctggtgatcactaatatttacttctttagaaatatgtctagaagtatgtttgctcaatcaaaggttatgcaaaattagaaggcttttaaggtatactaacaaattgttcttttttcttaagatttcagcaaataagactaatagctaaaataaaaaggactctgataaacatttaatacaaattaccctctttgagacttacaatgatctttgaagtagatagtgttattatcttattttacttacgaatgtaatggaaatcttgagtgattagtatcatgattgaaatggtaaagccagtgtgaacctaagtctgattccacaccaggtttatagtcactgtatttgcattgatttccaaccacactttccaggattataatcgcagtggccaaccctgtgtattatattttttttttgttttttatctttgccattttagtatgggagaaacattttatcttgtttcaaccatatttctagcattatcagtgcatttaatgattttaaaaactggcatttaaacatttcaaaaattgttattgcaaattttctagtgatattgttgcttatgtttccattgggggttgaaaggggtcttttttctcttgtcatttataagaatactttgttaaatattatcgccctggtcatgcattttgcaaacatttttctgactttttgtttacagttttttttatatacagacttttcaagtttatatattaaaaccaatgtttgccttaatactttctcttttttgtgtagaaatgccattcatttttaaagtgctttgaaaaaacatttatatcatcataaaggcataatatcaaaattggtactcagatcatagtcttattaggaatatgttatatctactcaaactgatattaatttttatttaaaatttacataaaatagctgggcatggtggcatgcatctgtagtaccatctattcagaaggctaaggcaggaagatctcttgcacataggagtttgagtccagcctgggaaatgtagcaaaaccccatctctagaaaaaaaaaaaactctaatacataaaatatattcataattaggtaaaaattaaattaacataacatttataacataaacattttactttgaaactaatcactgtaacaattttaaaaattcaatgctgtttccctctgaatagcagcacatctttaattaaaaatgaataaaaatagccccatacacattgtaccttttccttttaaaggcaaaaaaatgtaaagtaatggaaaaatattcacaaccctagtgaatgcatttataatgtttctttttctccctggagccactcatttgaagacagctagaaagcacgtggaaacattccatataatttattgcggtaaatgattcagagctatttttcaaggtagcaagcctttaaggaagcttatgctagccatttgttaaaatgctgttttctgccaagattaaagaagagatcattaggtatgatctacacttttatacaaatatctcctcctcgtctaacatctgattacttaaattgaatctaatcttatgacaggtgtattaaaaatttagagagtaaacaaatactttgtttcattacagatcctctcctagagaaagcttaattattttattaatatgttctaatgtactcacagattgtaatgaatacattcaacagatatatattcattttaaagtttgcatttttataagtactgtaattacttagaagccatttcaatactaatttggtccctttttagtagcttgcacagtggaattaaaacttaccagggatttcacagagtaaatttgcaagttaaatagaatggcctatgaggaaagaaggaaaatctaccattcattaaatgtttaaatgagttggatacatgcaagctagaagaaagcagggttaccacaacttctatagaaacaggaattattacaagagcctttcattatcattaatgcttgactgggagaacttctctggtctttgctgactttgtcctcctgtcaggagattatactatacttgggatggaatgctgtcttagtctatctgggttgctataataaacatacaataaactgggtggtttaaaaacaacagaaatttattgtacacagttctggaggctgagaagtccaagatcaagacaccagcagatttggtgtctgatgagggaaaagttcattgagccttcttcttgcatgctcacatggtgaaagagaagagctagatctctgggtttctttcatgaggacactaatctcattcctcggggcagagacttcatgacttgatcaccttctaagggcccagacttctaatgctatcaccctggggactggatttcaatgcatgaatttgggaggggggactcaaacgtttagactacaacaaatgataatttcagtcaatcattcatccaacaaaacctgattatcctagtcaataataaacactctaggtagtatatgactaaggggaaaatatccaaagaaaagaaacgtttcactttggctagctttttgggggatcatgagttatctctttaccctcaagttcttcaaacaatgaagtttgaagttttcttttaagtaaatccaataggccctgtgatcatttgatcagtcaggtgtcaacaaagtcttaggatacttttacatgtcagtgaatctcttattgccatgctactctgttcagtcttgattcttcacattttatttttctgcaaaattaatcccctcaagtttaaggaggcgtcaaagttgtaccatatcctgggcttgcagccattgtttcaaactcagtgtgtctataattaccttttgtcccaagccttttgtcctctaatctctttctttcatcttttacatttttctctctcatctttcatcaccccatgctcactacaaactggacctaagccctggggattcattctactagtctttttaaaatctatttcttcttttcttccattaataactcagctttctaaatttgagccttgattgcctcagacttgaattactacaataattttcagtgtagtttccccaaactccagcctgtccctatcttcattccaccttccttaaataattaagtgatgactccgtcgaaattatcgctcccagttggaaaaacaaacaagcaccaaaaaaaaaaaaaaaaaaaaacctgaaagagttcctagttattacaggataaaattggcattgtttacacaactttgacccctttctgctctactccatcaactttatggaccctgaccagacttgtaaaaaattgttattgttagttgttgtttttcttatagctttgccttttcttaaacccatttgccatgaccttgccatgcttttatttatttatttatttatttatttatttatttttttgaggcggagtcttgctctgttgcccaggctggagtgcagtgacacaattttggctcactgcaacctccacctcccgggttcaagtgattctcctacctcagcccccccgagtagctgggattacaggaacccgcaaccatacctggctaatttttgtatttttagtagagacagggtttcaccatgttggccaggatggtctcgaactcctgaactcaggtgatccacccgcctccacatcccaaagtgctgggattacaggtgtgagccaccgcgcccggccacttttagaactatgtaaattctatcaatctagtcgcacttcaaaacccaccatctctatatagtgctgtattttttctgcttttcaatatacatttatatttcctttgaacttagactgcagaattttttctcttgtttttaacttatatattatttctcaatattttattctttaatcattatgttgtcattcaattatgtatgtttcattatcctatctgcaaaaataaattgtagtcttttttggaagcaagaatttgttgtttttctttttaaaaaatccccttacaggaataaacgcttattaaaagaatgaacaagtaaacaattgttataaaaatgtttaaagttacacaagagcctgttatcataaaaatagcttcaaaattctgactacataaactaaaatcatcttcctggaggatgaaattgttcctctagaaatgtgtggatttggggctttggtaactgaaaaatgaatatcaaaagatacccatgttctaacccctggagcctgtgttttaccttatgtggcaaaaaatattttgtagacatgattttgttaaagatcttgagatatggagataatcttgtgttatctagatagccgcgctaccacatgtatccttataaaagggaagcagagggagaagaaaaggtgatgtgaccatagtggcagagcttggagtaaagcggccaataagccagggaatggttgtagtcacaagaacctggaagaagcaagggctagattttcccccagaccctctggagggaaagaggccctgctgatacctgattcccacccagtaaaactgattttggacttctggcctcctgaaatgtgagagaataaattcctgtttaagcttccaagtttgtgataatttgttttatcaacgacaggaaattaagggctcacaaagaaaattctagaaacagtatagctcagagttcataaatagccaacttctttggacaaaaatttctaagatactaaaccttcctcaaagttggaaacatacatgatttcatcctgatacttctaaacatgttgtgatagctagaaagagtggacctcagttatatagtactgattcttcagaaagttttaattgtagaatttttgtttttagagattctattttaactcaaatttttgtattctctaccatcatagtaattgtaaataacattgtcaattataaatcctatattaataaaaatataaaataactaaaatgaaatccttaaaatattaaatgataatggctccttctgttaataaatcctgcacaggagtgttaaaattattttatccaataattgagcaaaaaatcaacaagtaacattttcctaattcaagaaaattatatcagaggaacatctatgaaaacttggagttgataaaaacttgtaggaacttgtgatctgatcctgccgagtgttgcctggccacagtgttttctagcatagaaatgttaaatatgtcatgtttggcccttttctttccctgacaagagttactcaaagattgtaagtttttgttttctttcttaagatctcttaaaaattgaaaactagtattggctgttttttagatttatcttttaagtattgtagagtctcattttatgtttctacattttgattgttaacatctaccatgtaagacattttttcaaaagtgttagaaaaattgtcaattcaagtcaatctagaaaacaccttttccattttcataagatatttaaaattcatttcatgggatcctacattgatttaaataagtcacaactttggctctatgctttctagctatgagcacaaagttggttatatgattccttgtgtccataatattaaaaaacagcttcgtaaaagttcagatattcctggtgttaaaatcataaggatatctactgtgattatcgataagaaaagcagtacatggaaaagggactatggcaccaacaagggaaggacaccagaccaaattggagaagacagtgtctaagaaggcatcttagaaaatagcaaagtatgtcagtgcaaatagtaggacaaaatattattctgttgattaattggttaaagtatatcaccatcatcccatgcataactgagattaatattacatttctataaggcttaaacattaaaatgatattctgttttttaatgtacataaatgtgtatcagttttattaatgggattcccagaatatttggaaaaactccccttaaagtgaaatatcacagtaagtgtataaagcagaacgtttaatactaccctggtttaataaaaccccactacatacacacacacatacacgtagacacaaaggcgtacctcaaccatcaggacaacttttcttactgaaaatgggaatctgttacctgaaaaatttactaaaaggaaaatgtgttgctactaacagcatccactttgtacccattgcccaccaatttgtctcctctaaagctcctgttatatacagatggactgcaagctctctgctgactttaccaagatgaatttgtctccattaaactagatatttatttccagcagaacttattactcctgtgtactctttaatcttctgaccctcattcttttctccaccttgtcttcaaatagttttctcctgttttatgcctaattcgttttgacttgaggctataaccttactcattactgtgaaatgtatccttgttcaagtaaccttccggccaacattttatcatatttaatacttttttaattaaatgatttgaatgcatgagtctactatatgtgaagaatattaaggtctttcgaaatactcttctattccccatcacccttagactagctgtatgcctatttttcatcaaggacataattattttcaccataaccattttaagcactctataatagataatataactttatcttggcttaatccatgtagtaaaagtcagtttattattttctaggtaaggtaaataatgtctgtgatttctaaattaacagcgttgcctagcccacttttatattcttgagaagccaagcagaatccatacttatgattagttgctttgctgtacctgtgattgtcttcatcttactgcatttgcaattccatcctagttattaaattgttacagttttggaataaattaggcaaggatattcctagttttttttgctttttaaatatgaaaacttattttttcagaaatgaaaagatagcacaataaggccaagatgacataaaactatacaagaaattcatgttcaaatagttgactaggcaatactaatactttatcccgggaagagaaacattaagtttagaaaaagaagacatctgaaaaaatatgcaagtgaaatgaagatatttgatatattttatagcacaaaatacattttatattctgtataagattttttaaagattccttgcttaaaacttaccaatttttaaaaggagtcatcaaatataaaatattattgaaagtagcccagtgtaaggagactaatcaagtggaagctacacatcgatatggctaaaacacaatgttttagatatgtcatttaaagttaactatatatcccatatatattttgccttgctacaaatatagacgtagtagtcatactatgtcagcaaaatatcttctattataggttttacatgccctaattatatactcatgatgtcaaaaaggaattggatctgagatatcatgagattgtcatttttctgtataaatgatgaagaaaaattatttctaatttttttccaaatctattcttaacattaaaagctatctttatattgaaatatgtctaatacttttttctttgcacaagaaatacgttttctaggattttattgcattctacactaatttgaagcatgtgttagcagtatgaaatgggttttttcttttaattacatcatatataattatacatgcaagaaatatatatatatttgttatagatagatatcgctgtttaaatccactttgaaacaagatgtaatataaataggcacacaaaccatatactcaatctcatagggaatacaaaagaatcattaacaatacagcaagcattcataatgctctacaggaggcattcaggaaaagttctgataaggacaggaatgggtctaaaagactccacaaagcactcagcgtgcacagagagcagagggtgagtaaggacagcaaggacactgccacaaatggaattgaaagtctggagtgggacagtggaaaattaagttttacaagtagaagagctaagattacaatagaaggtaaatgtcaagcaagggaattttgacttgaggggacaaaagaagcaatgagctttcagactacaaaggttgtcaaaggatcgtgtgtaataagcatcatgaaaatacttggactgcacttttgttattaaaaatgacactgtgaattcagccaaatatgaaaagggcttcttattcatgttatttagtgttgaagtctaatttcacagcaagcaggggcagactgtagaaactttttcaattcatttcttttattctgctatcaaaggatttgatccaatacaaagcatgaagctacatgtggtgtatacagaaatgatacctttccattaaaggaaaaaaagcttcagtaggtaaccatggaaacagcctagtgtccattccaatttcgaatagaaaatcttagtcttctaatgaaaacctaccagatagacatacttctactccagctctctagttctaactctctaaaaaggtttggaatattcattttatttaagaaagtaaaatatgtgtttatgactgtaatatgcaaaatttgattttttcttttagacaaaaaattcaaagatgcattttaagaccgtaacaccaaggaatgatcaaagtggtcttgatagctcaccatagccagtgtccaattcatggtttacacattactgagagcaagtgccacttctgggtggcagaaattgtcatgttccaatccacctaacaaagagacctgattttttttcttcactcagtgagttaaccaagtgacccgtgaggtggacttattttttttattattattatactttaagttctagggtacatgtgcacaatgtgcaggtttattatataagtatgcatgtgctatgttggtttgctgcgcccattaattcatcatttacattaggtatttctcctaatgttatccctcacccctccccccaccccacaacaggccctggtgtgtgatgttccctgccctgtgtccaagtgttctcattgttcatttctcacctatgagtgagaacatgcggtgtttggttttctgtcttgtgatagtttgctgaaaatgatggtttccagcttcatccatgtccctgcaaaggacatgaactcatccttttttatggctgcatgctattccgtggtgtatatgtgccacattttcttaatccagtctatcattgatggacatttgggttggttccaagtctttgctattgtgaatagtgccacaataaacatacgtgtgcatgtgtctttatagtagcatgatttgtaatcctttgggtgtatacccagtaatgggattgctgggtcaaatggtatttctagttctagatccttgaggaatcaccacactgtcttctacaatgactgaactagtttacagtcccaccaacagtgtaaaagcattcctatttctccacatcctcttcgagctggacttattttttaaatgtatgaatcttaatgtggtgttacttataaatctaacataaatacatagcccccaatttcttactgaagctttaagagacaagttaaaattgttctctgggatcccttgtacagaagaatttcatataagttttgtagcttactccaggaggtataacataaccttcccccttccctggcatgtgtgctgtgttgactttcttccaaagattacaatgtggaagaggatagtggcaactttacaatggagaaatattggcaaatactaccttgagtatgtaatcaagattctataatgtgagtcatagtgataccgtgcacccttgaagtgatgggaatgacactgtacctttgaggtcttccacccccaaccctagacccctaatccagccatgagataaacattagaaaaattcaaactgagagatattctataaagtgcctgataagtatttctcaaaaccatcatcaaaaagataaaagtctgaacatctatcagagtaggctgagggcatatgatgactaaaaatatattgttggatgggatcttggaaaaaaggagcatggattggattcgtaggggaacatgatggaaaacctaatgaaatctgaataaactctagagtttgaaaagtatcaccaagaagtgaaatgctaattgtgtggaaagaacatgggacttggagcctgacagaccatagttcaaacactggctctcccacttgcaaacggagtgactttgtagaacttctttaacctttgcaaacctcataatcctaatttgcaaaaaaagaataatactgtatgtgctatatcatatttaatatacagtatattttaaatgaccactgtctttcgtaacacacaacagttgctcccaaaatgttgtttctccccttgcttccagcccaacatcaaaaggctagcacctctgaccctctgggggtcttttaaccaaaagaggctgctttgcccatcagtcacattaaattctgctccctggaagctcacctcaagcaaaagctgagggcagatgatgtataaatatctcagccctgtcactctttgagggactgactccgacgtgcttattctacactggttgccagggatccccaacagaattaagctctagttatccacagtgtaactaattagataatttaccatgtattagcctttttctcttccctaccaccatacttgtcttttctgagatcatattcctaacgaacgacttgcacttgaattactgtctcagtgtctgcctttgggggaacccaaactaaatagaccctgctcttagtttgcagcaatactgacagatgctataagtaaataagatttctttaaacttgaagccatctagaaaactttggtattatttgcacccaatgcaagcattgtggtaataattccaaggtaaattttgaatattgtgtccggtgaagagtactctccctttacagatagagagttgtaaacaatacataagtatatcattgtgccatttaggatattataatttggcttttcagaatctttatatatgtaacaattttatctaattacatgcctgaatatatctggtatagtatataccagagttttaggaagtgtctaaagatacaagtgaaaacttttaaaattgtatgaaatgttacaaaaacacctgtaaaagacattcagatgggatagcaaaaagtcttttatcattatttttcagctattgaaacaaacactaaaatacaatagtttatctaggtgtcatgtgaatgatatatttattgttgttatgtctgttttacatttacatgcttagatcagtaagaacctcaaagatcaggtatcttgctgcataatggtaccaactaatgagactggcataaagggaaactatgtatgcatgtatgttgcccattgctaaagaagaatatctcatttaggagtcagtgttcttgccttgaaatatatgttcaaaagccagttcttcacagaataaatacttaaggaatgatccagttgagaaaacataggcgaatataccatcaatagaaagataagttgccagaagaccattacaaaaagaagagagttcaaatgaggttggaatagtgggagaaattcttacagaaatgataacactcggttagatgtatgtgtattgaattcagcagttcatgaaggtgatgtgtaatttggataaacaagacagattaaacacacagaaaagtatgttgaataaatagatgattgaatagctgagaaatagaatgatagagatgggtcatgggagatgatgtctcacatggtgagaacaattctagtttttgcatgtttcctttttcctgatggtcccgtattagttttctattgtttcataacaaattactacaaatttagtggcttaaaacaacacaaaattattatttcacagtttgtaagaggaattcaggcacaatgtggctgggttctctgctcagggtctcacacagctgaaatataggtgttggccagagctgtgatctcaactcagcctcaggggattcctcttccaacctccctggttcctggcaaagttcagttccttgcagctgtaagactgacttcctatctttctttgttgtctggctctctgccagggttgcgctctgccagcagctagaggctgccctccgttatgtgccatgtagctctctccaaatcatggcagttttcatcttcaggccagcaggagagtccctctcttcagtgctaacccaaggttgtatctaatatctttgtaatataatgtaatgtgatcttgaaatgactgtcctgtcatggtcacagtctgtcttgcacttaagggaaggaggttatacagggcatgtataccaggggatagaaaccttcggtcatctgcaaattgtacatcagtcacataaaaagcaatatgtgtacattcaagcataactcgtgggatatattttggaagggattcccaactgagcttaaatttgcaatttatattcttcaatactgcaatagtaaaatataagcatctggagcatgtttataaattagatttcccaaattgtagacttcctttaaaacccttcagggcagagtcaagtattaaaattacataaaatttaacattggtaatgtttaaaatgggaagatttaacaatgaagtagaatagaaatgtcagtcacattttgttattatattactgcatgtggcttattgtattatcttgcactgttgctctgtttcccataaagactagggaatttcaaagacaaattattttcatttcaattcaattcataattgttggacactactctcctactagaacagtttccatagggattcaaaatatatccttagcattgttattgagtccacaagatttttttaaaagaatataaaaaccaataggaaaagatgagatagaatataatcaaatgtagattttatgcatgaatattgcacagataatcactaatatttagatattacttgaggcaaatgctttgtttagagcttacatgaatttggcttattcagtctgtaaaatagcctatgaaagaggagccatatatttatcctttttctcagatgaggaatccaacattttgacaaagactcccagtaaccctggtcctgagtgatacctctcaagcttaggtttgtgtaatcttctagagcccattgttgcagtattgtccaattccaaatatatacagatatgatacctacctgcggtacaatggcagataagctatctgggtaaaaatggtaagagagtgctaaatgaaaaaactgaagaatgtatgaagactttaaggagattagccttttgcttggcaaagcggagtgggaaggatagtcctagtgatgtgatcagcacatacgaggtcagggatggaagaataagctggcttgctgagtgcaaattaagcatcacattgttatatattgttatattgaggtgaaagcagaaagagtgaatgctttacagatgatgttgaggacaggatgagaatactgaacataagatgcatacccacatcctgtttttagttgtagaattttagagcattaaagctgtaaaaaataagtgatatcatgtagatgtgtaagagtaagttaagagtgtacagctagatgctacttactcctcctgaccctcctctgaacaaaccgctgagctaacagcctatagatgaaacctgaaatcaattcaggcataggaaaaggtactgtctgggaataaacttggcagctccactggtgacttcaataccatctatgaattctccatgctgacttcaggatggtgtgaatatggaggaagataatattttaaaaaataattcacattgctaaaggtataatttttgttgctaaacagttatctctttgatttcaatacaaattttcttgggttatttttacagatgagggagaaaatcattatgacaagtttattttcttacaagttttatttctggatttttgttgacacacttttcgaattgactgcgttccaaatacctaaagagatctcccagaggatgcaaaggtccacaatgactaaataatgggtgtgtaaagagaagtttaagcccgtggacaaatagtggcaaatagcagagcttcaggttcagagagacctccgtcactaagcagctcggacatattgggaatcctgtaacttctttggcttcagtttcacttagcgaagcagttggcaaaattcgatatatatcaaactgtgaacttttatagtaaatattgtcctgatgaactcgcacaagaaaagtattttataatttaaatgtagggaaatcaaaacctatatgatagagctgcaccaaatatacatgtagacattttgaattcaaatatatattcatttgtaaactataccttaataaaaataaaacaaaaatgaatacatgtatatgtatctaggcatacattgttttattactctttgctttattgtgcttcacggatattgcactttttaacaaattgaatgtttgtgacaaccctacatggagcatgtctattggcttcatttttccaacagcatgtgcccactttatgtctttgtgtcaaactttggtaattctcccaatatgttaaactttttcatcattattttatctgttgtgatgatctatgatcagtgattttttttttttttttttatttgagatggagtctcgctctgtcgcccaggctggagtgcagtggcgcgatctctgctcactgcaagctccgcctcccgggttcatgccattctcctgcctcagcctcccacgggcgcctgccaccactaactattgttaattgttttgtggtgctgcaaactgtacctatataacaacagtgaacttaactgatgaatgttgtgtgtattctgactgctccacagactggccattccctatctctcgctccacagactggccattccctatctctcgctccacagggcttcctgttcctgaaacacaacaatattgaagttaggccagttaataaccctacaatggcatctgtgtgttcaagtgaaaggaaagtcacatgtttctcactttaaatcaaaagctataaaagattaagcttagtgaggaaggtatgtcaagagccgacacaggccaaaaagtaggcatcttgcaccaaacagctggaaaaatagtgaagggaaaggaaaaattcttgaaggaaattgaaagtgttactctagtaaacacataaatgaaaagagagcaaacagccttattccgtatatagagacagttttagtggtttgaatagaagatcaaacaagctatgaaatgcctttacaccaaaacttcttccacagcagggccctaactctaattctatgatgggtgagaaagctgcagaagaaaatttgaagctagcagaagttgatttatgagttttaaggaaagaaagataacataaaagggcaaggtgaagtagcaagtgctgagggagaagctgcagcaagttatccagaagatccagctaagatcattgataaatgtgaatacagtaaacaacagattttcaatgtagataaaacagcacccaattggaagaagatgccatctgggacttccatagctagaaaagcgaagtcattgcctagcttcaaagcttcaaaagacaggctgattctcttgttaggaaaaatatagcgagtgactttaagtcaaaagcaatgttcatttatttaccattccccaaatcctagggcccttaacaattatgctgaatctactctgcctgtgctctgtaaatggaacaacaaggcctggattatagcacatctgtttgcaacatggtgtactaaatattttaagcccactgttgtgacctatttctgaggaaaaaaagattccttttaaaatattactcctcattgataatttactcagtcacccaagagctctgttggagatgtacaaggagattaatgttttcatgtctgctaacacaatattcattctgcagaccatagatcaaggagcaagttcaattttcaagtcttactatttaagaaatacgtcttctaaagttctcactgccatagtgattcctgtaatagatctgggcaaagtaaattgaaaactttatggaaagtattcacaattctagataccgtaaataacatttgtgattcatgggaggaggtcaaaatatcaacaatatcaggagtttgggaaaagttaatcccaaccctcttagatgactttgaggggttcaagacatcagtggaggaaataatttcagataaggtggaaatagcaggagaactagaattaggagtggagcccgaagacgtcattgaatttctgcactctcaagctaaaactttaatgaatgagcattgcttcttatcaatgatcaagaaaagtggtttcttgagatggtgtctactcctattgaagatgctgtgaacactgttgaaatgacaacaaagtatttagaatattacataaactcaagtcgataaagcagtgtcaggttttgagaggattaattcaaattttgaaagaagttctaccatgagtaaaatgctatcaaacatcacatgctacagaaaaatctttagtgaaaggaaaagttgattgatgtgataaacttcattgttgtcttattttttaaaattactacatccacctaactttcatcagtcaccactctggtcagtctgcagccatcagcattgaggcaagaccctccatcagcagaaatattaccactcaccgaaggctaggataattgttagcatttttaacgataaaatatttttaattaaggaatatacattgttttttgagacacaatgctactgcacgcttaatatggctacagtatggtgtaaacataactcctatgcacaggggaacaaaaaaattcatgtgccttgctttaaatgcgatacttgttttattatagtgatctgaaactgaacccacagtatctctgaagtttgcctgtgtatatgcatgtacatacatacacactcacacccctcttcatctatggattaaaaaaaggaaagaaagaaaccctgtggcaagataaagcaagtaaagggcatttaattcctgagatctttgcagaaagagacaagattcaggtcccaataatacagcaatgcctttgctttcttactttgtaacgtgtactgctggaacaaggtttcattagcacaggctcatgctagagatttgagaaaacgtttgtttgtagtttttctaaagggtcatgaaaaaagagtattttaaaagaagtaactatacatatattaggattttaaacataatacaactgggaaaaaaaatgtggacacctagtctttcattatataaaattaatttaacagaatattttagatccttctcacagaagtccttgaaattatttagatgttttaggtatttgaagaattgtaaaatgtctttggacattctccctaaaaagaaaaatccagaacaaaccatacatgtacgtgaaaaagaaagaatgcttaccatctgatatgatttggctgtgtctccaccaaaatctcatcttgaattgtagctcccataatccccacgtgtcatgagagggacctggtgggagataattgaatcatgggggcaggtttttcccatgttgttctcatgatagtgaataagtctcacgagagctgatggttttataaagggcagtttccctgcacacgctctcttgcctgccaccatgtgggatgtgcctttgctcctccttcaccttccaccacaattgtgagcctccccagctatgtggaactgtgagtccattaaacctctttcctttataaattacccagtcttaggtatgtccttatagcagtgtgagaacggactaaaacatcatctatgaaaagaaaaatacagagattaaaaggaattgagatttgaattggctttatatgtagtatcatccattatagatagtactcatttgattacaatataaattcagaagcagaaatcattacgacttcaataaagtatacataaaatcaggaaatcacctagtcacattataaaacacctttatgaagatacagctataatataaaagtattttgaaaatggttgattttatactattggaaagtataactggatgttaaaatttcagcccagataccaagatacaataaatgtgaaatgtaaaatcagatttccctatgcaaaatttgcaatgacaatctaaaatcagattttcctgtgcaaaatttgcaaagacactttggaaatctgatttcgtgactttagacacttcaaccagcatgaggaggaaaaggaggtatgttggtttgctggagctgttgtatcaaattactgcaaactaggttgcttaatagaaacctagtaaattgcttaatagaaatttattgtcttatagttctggaggctagaagtctgaaatcaaggtgtcagaagtgccatactccctctgaaacctaagggagaatcatctttttcctcttctagcttccggtgtttgccaacaatccttggtgtcccatggcttgtagatgcatcattccagtctctacttccatcatcacatggctgtcttttctctgtctctattctcttataaggacgccagtccttttagattaagggcccatcttactccagtatgacttcatcatgaggactatctccataagtgtgcacattttttggtactggtggttagtacttcaatatatcatctggggagccacagttcaacccataatggaaagtatcagaatatgaagaagattacaagattttgcctggagagattagttgccctccctctagaggagatgggctgggattctagcttccagtaagaggaggattcaaggccaggaagttcttgagcttgcaacccatgcaatcacacagatccctacaatcttggaattcttggtaattttataaaaataagttctgcattttcattttgcactgggacctgcaaattatgcaggatgccagttggagagcttggtatatgcttctggtacttgagaatatggcaggctgtggcctgactcacacatgataaggctggcttgtgacaactgaatacagggagctgactgcactgcctaaggttagcctgcctcccagagttttcacaaaaagtggctcacttataaaatatgcattgtcctctctctttgcacttcagttaagaggtgctcagagatgggaatctctaagaaaatccaaatggtctcaggacagggagctttaaatctctggcaggccagagaacaggaaggagttatacaaaccagttcaagtaagacctctcttacagctttgccactctggaagaataaaaaaataaaaaataaaaaataaattgattagcagactgggtgaatttaggagtgggtaggaacagtgaggaataaaaaaaaagcttaagtcgtaaaacagaaaaagcctttgcctctgcaggctgccaacataaattaggcccaatgtgaagaagggggaattatttgatattacattacatttagagttttgattagtactactaaacagtatattctaatttctgaattgaatcccaaggtgatctaaacaggttagccaaaaaaaaaaaaaaattcatgtacaccatgtttttcatttaggaataaggaaagatatgttatctactccaatacattgtaaagggttagtggtgttgtggcctgaattgtgctcttctagaaattcatatgttgaagtcttaacccccagttccttagaatgtaaccatattagagatgagtctttaaagaattttggcatcattagggtgccctaatctaatgtaactggtgtttttataaaaagaggagattaggacacatgcaaacagagaaggaagaccgtgtgaagacacatggagaagatccctcttacaagccaaagagagtggcctcagcagaaaccaactctactaagatcttgatcttggacttccagcctccaaacctgtcaggaaataaatttctgttgcttaggccacccagtccatagtactttgttatgacagccctagtgaactaatacaacagtaaacaataaaaactgagttattacagtgattagtttgttggtttgtttgttttttttagaggagtctcgctctgtagcccaggctggagtgcagtggtgtgatctccgctcactgcaaattccgcctcccgggctcacgccattctcctgcctcagcctccagagtagctggaactacaggcgcccaccaccacaccctgctaattttttgtatttttagtagagacggggtttcaccgtgttagccaggatggtctcaatctcctgacctcgtgatccatgcgcctgggcctcccaaactgctgggattaaggcataataatcaacaaggtccataaaatggagcatagacatcatcacctgtatcattatcaccgtcttataagatagctgagattaaaagagttgactcaaaaatggccattttagtggttgtttgtagacctagcttgactgaaggactacatgagaatatatgtgatactagatagctcataattttacagttgagacaacatgaacattaagtgtgaaacagaattttaaaaacactataaattactaaatccataggattcatacaaagagctctacatgttacattttgcagtactgtaagttggtatacattcatagaaatataaatgtaattgcacaatagaagaatagagcaaatttatttaatgtaatatatacgaagcatagaacacattttttaaaaaaggtagtgttcaattaatgttaactttctccctgtttcctcttttataatggaaggaaaggcacagaaattgattgtttttccctgcttctagtcagcttaatcaaagtgattagactttgaaccaattaattgtcattaaagtcaggctgccactggaacaaatggaaacatatgctaaatctatggttcatgtaacacagttctgctttactaactattggtaaccgatgataaagcaatttgagagataattagaaaaggaagaagaatagtttccattattttaagagaatgtacaatgagattttattaatgaatgaatcaatcttgtatcgtgtagttatcagtatatgtgatagtttaaggtaaagtgcttcattggtgtgcaggttagaaatattttaactcacatagtcaggcataaaggtttcaaccacagcaaggacaggctgggccttacacatactaactgagagtgtctgtggagtagtgagatggaaaaacaagcaacagctatagggaatagctgcttcctaggaaatacagcatgagatttggagattgtccccaaagtcataaaggaactcataagtagttaatctagagggtcataatacaatgctgaaattatcagaaacatctgtcatcaggtattataaactctctctcgggacttgtgtagtggccaagggtcagcacagacaggcaagagcaaacattgctggacccttatactaaaatttcttggcagtattgggaagaaatcctcaatttgggattaactccaagactgggaataataactctaaatatcagctactgaattttgtctgtgtgctagaatctctgcaaagtatttcacatataatgttttcagtatacccaaagtgaattccatgaacctttcacagtagtaaacatgaaaaaaattttaataatgacaattatgggttaaaaagctaatggatataaatgataaataattgagatcaaacctaataatttccagataaaatcaagaaggatatgtatatactgacatgcactgacttttttattattatgaagagtaaaagacatcctagaaacaagcatacaaacgagattatttcccaggtacacaaagcaaattaatcctgattttacattaatccaagaaaaataaggaagcattatctacagattgtttttaacattgcttgtgagccaaatattttaacatctgttaattttttttcaagtacaaaggccaaaaaaaatttagcagacatataatttatatacacatataagtgcagaaactgttctacagatatatctttcttaaatgtacgttacttataactgtaacaaccacaaatgaatctaaattagaaattgaggatcaagggatatatggtagactgctctctgaaaggttcaacaggtactgtttccaaactatcttaagacactggagaagaatacactgtataaaaacggcctgagccattagaaaattaaggctgaaatggatgttatgatgtttccttttacactggcatttgtacactttaaaaggaagcaattctaatgtcgaagactatccttcagtattgaaataatcctataatgaacaaaagaaatttctctagaaattttcttctctcagcttaagattctcacttgtgtaattaaataagtttgtaattgtgtttaagataatacggtttggggaggatatgaatatttctgtttgatgggtttttattttattcttcttaggtgaccatatgttcttcataaaaaacatatgaacatgaaaaagtaaagaacctagaaaatttatttgtgaattgaatatatgaagtctgtgttatattttacataattcaattaaatgtacttcacatttctcaaatttgtatattattgagaaaatgtataacctttgtgaagaattttctgggttttgttgttgttgttgttgttgttttgagactgggtcttgctctgtcacccagactgagtgcagtggtgtgatcatggctcaagcaatctgccaacctcagcctctcccactcagcctcccaagtagtggggacaacaggcgtgtaccaccatgcttggataattttctttttattatcgtttgtagagctgacatctctgtatgtttccctggctggtctcaaactcctgggctcaagcaatcctctcgccttagcctcccaaagtgttgggattacaggcgtgagccaccgaaccaccgacccagccccccataatttccttttaagcggttggcagaagagggtatttgtgttctgtcattgattttgccgcttcctctcaccacttcttgtggttttcatagaagttctgagtagcaatgctgcagaggcaactcttccaagactaactcgttcagcttacggagctccagagtttatgttatttgtaaagctgacttcctcagatttcatcagatatctttgagaaacaaaaagaccctgacatgacctttctcattatgtattctgttgacattgcaaggagaaagaaaaacccacagaatactgaacaatgcttatcgtagttaaaagaagaaaacacattctataattatgtgcttaataaccctcatgaggctgggcatggcggctcacacctgtaatcccagcactttgggaggccgaggcaggtggatcatgaggtcgggagattgagaccatcctggccaacatagtgaaaccccgtctctactaaaatacaaaacattaggccggcatggtggcgcatgcctgtagtcccagccactcgggaggctgaggcaggagaatcgcttgaatccgggaggcggaggttgcagtaagcccagattacgccagtgcactccagcctgacgacagagcaagactccatctaaaaaaaaaaaaaaaaaaaccctcatgaaaccttaataatcaatgttgtaaataaattattcacaccaggaacaaaataataaagattattatagttcaattgaattatctaacaaagagtccataatccaccgtgacatttcttggatattttcagaagaattgatgtagttaagcttaggcaaaccatattagagagataagtgtagagcctacctttaataagatctctagagaagatacttctacaaccttcagaagctcactgacagtatttaataaaacttacacgatgtacttatgttatcagaagaaagatttaaacttctatatgaaaaaatgacattgtagaattggagaactggtcatacaatagtaggaacagggactgccttcactgagctccatgcagtttgtaaactttattttacttaacctattgagagctttataatgcaagtatcatgaaagaactacagtgccagcaaataatgggtatttaaaggtttgttttgttaaactgaggcctcaccaaaacatcataaaacagatgactttgtccctattttgcagttgaggaaaaagactcaaagagatgaattagctttctcaagataacataccagcaatcgtttgaaaacacaagtttatctgatacgaaagcttccctggatagatctgctctattgtgacattttaaaacatacattttttttattagctgaatttatattttcaggtattttcttacactgctgacaaagaaatccgaaccgatgacttgtgcttggatgtttctagactcaatggacctgtaatcatgttaaaatgccaccatatgagaggaaatcagttatgggaatatgatgctgaggtatagtattttcttaatttacttattatttgatgcttaagctcagttatatatttcaacattcaacatttaaatcttaagctggtttttatctacattggcagaattagattttcaagcatgcaggctcatatccggtaatattaggatggcatatcatataaacaggtttcaccaaattggtccattaatataaaatatgaatgaggacaataaaatcagttttgtgtatgacaacttgttatctccatgtacatgccaaacataaattaggcaagaggtaagctaagcctatctgagaggtttgtatgaagatgtgcatacaggataatattgacaatatgtccatattttcaaattttaaattttacaatactaatcactgacatttatgttcctcaactggaaggaacaatatctgacaagattaacaagatttctttactgtttacagttgtaaatattttgcagaattcagtaaactaattagtcacataaaaagttgagtagcctcttctcaatatagcacacctttctgacagagaagagggagagaaaaccacaaaattactgttggaaatttatctccaggcagtgtgtaaaaaccagatcagccatcagatggagctaataaaaaagaaatattttcctttgcataacgaagcttactcttgaaaacagcttcatttctttcagttttcttttttgattaacaaaatgaattggttgtctgtgttacatttcccacattattaagtggtaggtgatttatttaaaaggaaaactaaacttcgttctgcttaaaagataaatactactatagaggtaaatgagtctcacagatgcagtattccatgcaagcctaaaattttctacaagaataacattttaaaaaccaatctacagagtttttggtattgttgatattttagcaagaccttttaaaaacctttttgaatgtcgttttaatatttgcatgagtctgtagtttcttaagttgaatactagaaaaatttactgaattctcataggatttgaaactggttgtgcagggttaattttgggcctaacactcatacagtgttaccaggatcttaggacacaaaatcatcttctgggccataattgagggcaaacactgagaattcttcctatgttgtaccagtgtgattaagatgctactgccttcgctatatcttactcaccttgtctgaccaccaatttttttctcttcaactattatttattggtaccatccttgatattaagcctacagaaaacagtgcctttgcaaaatacatgtaggtaaatccttcatcagtactctcttctatgaggaaaagtgcagtaaaatgtacagatatagtagaaatcctgtaagtgatatttgtttttaaataaaacttgttcttcttgttgttactgttccgtttctaccaggaacctggggctctactgagcttatgctaaaaataagaaaatctagaatatatttattaagaaaggggaatgatcgtgtacatttttataaaagcaagcagtgtggaattttagaataccacttttaatctttaaacttttccataactcttgagtgaacaatgtcataactcaaattctttcatttctcaaataactactgttagcaatttggtgtatattttggtttacattttctgtcagctagtagcaatgctattgaatactaaggaattttaagtaaaaagtgaaaaaaaaaataggtagcttcacataggtagataaataaatgatttctataaatttactcttttggatgactagtagttatctgttgcagtatttcagagcactataatattttgtgtcatgtttactttgactttggaacacacgcacaaaaagcttataaaatgtcataaatattgagaaatttttattttaaataatttgatcatctgaattatatagcttaattaaattctcttatatgtttatgttttcaaaattaactagtgatgtttacattgtctaatgacagcactttgccaaattaaaaaatgcataggtcataatctaataaatgacatgagaatagagcaattgtaggaataatacattgcctttctggaaatttcagctttgatgtgcgattatatttttgagaaggtcgttaaaaaggattttttttaaacaaaattgaaatataacatttattactatgcttttcagttttacatttagggtttctttagttcacagaatggttccaccccttgctacccacagggtgattccaggagtagtagcatcacctgggaacttgttagaaatgcaggatccgaacccatgctaaacacactgaatccaagtttgtattttaacaaaatctccgatcattcatatacatatttacatttgaaaaggacagggtcaaatatctatgtatcttccatagtctttttatacactggttaaagaatgttacaaatttaggaaaaggcatgaatacaatttggaaaatggcaaggcctccagaggggagcagagagagggaaagggagcaaaaggataagaggtgttgagatgagaaagaggaataattgctcagtggttctattcttctcatattccaacctgtggaaagtaaatgcgcactgcttactactttaactcaattctttatcttttgctggcaaggacaaaattattctttgaaaaatctctgaggtggtgcaggttcaaggcagaataaaaattgttggagttcatagaattacagaactgaaatgtaccttaaagttctctcctttaagcctttatcaggaggaactaaagcataaagattacaccgctagcagcagagctaggattcaggtcctaataaagtattccaagcaagctagctatcagtacaattgtgaatctcaccatgtgaacagcacaaatattccatcaccttatctcccatagtcctttcaatcttagaaaagaaagtcataaatagaagcaagattgttggaatatccagagaaaaatggaaacagtgtcatgaagcctcaaaagatggaatctatccagctactttggttttgtttacttcttaggtgagtgggggaaaagagaaggaatacagttcaacacgtatttatctgttttctcatgcaattcttacaatagtcttataagacagttattctatttttcacattagtaaaatgaagcatagggtaaatgcctcgtttaagtttgcacagccagattctggcagtaaatccagcaatttttctactacactacattgcctcttgatgttgtcgaaaaactggaaataattagattctctttcagtggttaagatataataagctaaatatacagtatttcaaatggaatagctaaatgctatcagttatttgttatgccaaattttgaactaaaatttctcatttttttaatagggggaaaggtgttctacaataaatatggtccatttagctaaataagcagtcataaaactactttgtcattttgctctaattgcttacaaacttcagctatacatattcataatataatatctaattgcttatccttgtaattgaatgaaactaagcacatgttagtaataaatgcacttctttggtcaactttgatttcaagtgtagtttctcacacccctaactaaatagtccttaaataaccacgaattcaattcactgtcatcttatatgtggcctaacctgtttgaattgagggcatcctgggcatcattagcaaaattgtggggtacctacgtggtctggaagcttaaataaattgcacaaacccttctgtgccatgaaatgcctattgccaggattaaatgaagagaaaaaaattcatctcactgagacattttaaaaattatttttataaagttctgtcatccattaattctattgttttcaggtgttcttatattctgtttgaacattataattatgttccaatcaatttagaatatttccctatgatatgtgcacataattacatttctttttgaataactaggcagctacatacagtgtgagaatctaattttagatcagaacacttatgttcaacaaacactatgcaacaaagaaaaaaagggagaaaaatatgatactaaaaataacttatttttcatgtgactgagcaagttgacttagaaaatacttgttgtgaattctatatacatctgtatcaaataatttccagagtcacaatataaggaatttttttccataggtgaaatgtgttagattaatatttagactttacttacactaccatcttttatttacctttattagagagcaggtaaatgggattataatttcaaggtaagtgatctttaagtgcatcccagccattcccctgtgtagcattcctaagaaaaacaatggctcaatttaccttttgaaggttgtgtgcattacacagttattacctttccatattcctattgacccatagctgtgatttcttattagaagtagtgagtaggaatttcaatagattagcgtcatatttgtagttcctatatgttaaatgattacacttcatattttataatatttctgttcgactgaatgcgtagattaccttgtctggagatcataattaatgttttgagtaacaactttgttatattaatttttaattgttattctatgcttgattaacagaagaactcctattatctttgctattaaattaaatatagtacaaatttatacttattttgtatatgattatatgtaataacataattgattgggttttattttaatcttttactataccaacttttaaactgagacctgtgcgattggctcttaaatcaactatgcagtcagttcattaaaatatctatttttttaaattagtatgttttaataccaaggtatggcctaattttacaatattaatggctcttattttgtcaccaaaattgtttagcctgattccagttggctttaagtaggaattatatatttggaagggtaaagttagagatactccacgctacattttatgttagtcaaacttgcaaatatatttaaaggcatgaatcgttaatatttttcttatgtatttttacatgttacgattaaaatattctacattgcaggcaataccaaggctttgcattctagaggagaacaataaagtaatactatattataaacaaaactcaatactatcttagggtttagatgatcctatttttagtcaatattttaaataaagctataggaaaatatatttggcagtaagttgcatgtcagcctggatgtcacattgtcttcaaagttgagttaatatagctggatgtagtggcatgggcctgtagtaccagctacttggcaagctgagatgggaggattgctagagcccaagagttcaaggccagcctgggcaatatagtgagaccctttctctaaaacaaaacaaaagtagactaattaggcatttgcaacaaaaacagatataactaagggttgatatacctaataaagagcatatcaacccttaattactatactttttgaaagggaaatagtataccacatatagaaatgtgcaaggacttgaataaacagcatagtagaaatgtagccaaagaaaatgaaaaaaagtttttaaaaaacataaataaaaatcattttatgtgtgttactgtattcatttcttgcttatcctttcaatacagcaagaaatgtttttagcagcaacatgtaatattggtgaagatgcagtgagactgacacccataaagtatcctggcagatagcaagcacaagaagtgttagctgctgctgctattattacaaaattactgttatagatatattttaaaggactttgctgatatgtgttaaagtgttcatgtatttgaccttgcaatttcacttctaagaatcatttccaaagaaataatgacagatgtagacattgatgttcagagatatttgccatgtgttattaataatgacaaatatctctgaatatcaatatattgatcaaatatctctgaaatacaatatatttttgttatttgcaatagctccaaattggaaagatattccctgcaaataaaaaagttaaatggattttggaaattcattttagagaaatagtttatttcttaatagtatgtttgtagattattttagtgatagaaaaaatgcccacaacatgaataaaagaatattttattatatgacctcaattgtataaatacataaaattattagaacatacatacaatattaataattgttatcttttcaaacagtatactgagaaaaaaatgaactatgctttgttttcaagcaaatgaagacactaaataattttgtgtgtttttaaatgaaaaataatttttgtctcaataaggacaagatttgtaatttttcttctgggctatggctttttagaagtacctggaatgaaacttctttgactattttttcatggccattcatttgataaacacctttgggacatatgttacagtcatttttttaatgaaaattctatattgtatttatgccctggggtcatgtttccagaggataagcaaaatcattttgtttttgttttatgtcataaaaataatttttcttctatattacaaacataattaacatcatttacactaatatctttgttgttaaagtggcattttccaagaaaagttcacttcaaggagaaatatcactgagagtagaggatgatctagcctagcagttttgaacagtatgggtggaaaattcatgtttggtttaaaaacaaaaatataaactagtcttcttaaaaaatcaagctatatagttaacaatattatttatagttacagttttaatattaactacatagttaatattatgaatacaatgttattttttctttctttacaaattatgtactattttactgtggaagataaatccttgaaaacataaatccaataatttgtgttcattaagctgcctgagagaagtagcttaattttaacaggatttattgtctgcactggtctttcactaagtgtttgaatcaacagacttacttagtgtctcccaagggcaggcacggagcttcaagatgtaggtggccatagtctgtggctttcctggagcttatgttcctatggaggaaatagatggagagcaagaaacagacagataaattaattaattaaaattgtttggagaattagattaagagttaatctttttctttttcctcccttcattatctacctttctaattgacatctaacaaaggtggcaatgtacatgtggaacacaacccaggttagccttgtaaaaacataagtgggagcaatttgagtaccatactgttcaaagtaaagccttaaagctaaattatcctctgaatttgtccctgatatttatttaattttagggtgaaagaatgaggaggccaagggccatagctggactaatcaactattttgaatatccactcgcaaataactcatctggtactaaaaagcattgtattactaggatgaaggctgagaatataatcttttatatctaaaataaccttttgccaaaaatatttcattattttatcgtaagcccctctccatattctcagtcttatcttcatttactccttccttatagggttgatattaaagccatctaaaaaaatgtggctcacagctccatggatacaattattgtgacatgtgccttccatctttatccagtagaaattgcatgttgcctaggatgattgatttattactgtctttgtacttgattttgtcattattcgttattttctttgtcaaacagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggaggtttgtgttgcagattttattaaatttattttagcatttttgttatgttcagttattgaaatctggaaactcctttaaaatgtggttaagaaaaatttgtatgaccttttctccatggagttaactctctgtcttttacttcctagctactcattaatttggggactgcatatattaagttgtgtttagtctatccttaatgagtaggggtttttttgttttttttctttattttaaacatatatatgcataaatatacttgatgaacgatattatgaaatattaactctctttgaggcaaactatagccatgtctatatgacaacaggttctgcgtcatcagatctgaaaaaaatcgattaaaaaactaacagggccaaagaaagtattgtttctaagacactggaatcatttatttttgtttctttttattcagatactttggttaaatgcaaatatggcatatcctttctaaagtatcttattattttaattaaaacactaagcaaacacattattaaagactaagatgtgatttttaatacctttataaagaaaattatttctaagcatttctttgtggttgcctaagtgaaacaatatttttttaagttgtatcttttatctctcacttttacgatttgtgactatcttttcagcaagcaataaaatgaatcattacacaggtcaagtcaacaaactgatatggaattcttgtaaagagtgcaaataagaacatgtcctagcttttagttttaaagagtgtattatccaataattaaaggattttactttgtcccagaccttacaatgagaacacaaggaagattggggcatttttctggttcagatgaaccacttaaagattgttagtggaggaaacaattgagcttagaagtcttggaacaaggctagaaatgaaattatggatgaggggacaacatatggggtactattttacttagaactatattcaagccaaagacattccaaatgtaagagttggtaaagctggaaaagtctaggtcttttgcacaaagagaacttatgtacagagcaatttatgtgtattatcttagtttgctttcagagcaaccaatcctgatacgtgcagtgccaaaaaaggaagcttaggcttaactaaatatttattctcacaagtctactgtagagtgctagagcagagaccacagagtgcttctctccataggagaaattggagcagttcccttagcagttcttacagccttctttacaggtaacagtctgttgcaaggagatgagatccacatcaggcagatgtcaaaaccatcctggcttattagccttatcctcacagaagatgatgtttccttgtaacaactccataggcctagcttccaggaaccaaataaaacatttagaattacaagtctgcatttagaaaagcccgaagtttgcttttctgttagtatatatatgcaatttatcagttgcagatgcagtttatcaatcagagttcacttttaccataaacaatgtagcctagaaacatagttaacatttttaccctttcaaggttgccaggggattacagttagatagttgactgaaggtcaaattttttaaacaaaagggaaaaactgtatttgtaagcatgtttaagtctaagtattttctgacaaagaacatgattcctcagaataatttgaaacatgcctgagtgttcacagccagtaagtaaaggacaggaatttacctgagtctaaaaggtctggttttccactgcactacattataaaggagaagtatttagttgtttgtctctgcagcagtgggttttgactattagtgaattccttcaaataaatcatatattgtttagaaagaacaataataactagtgtttttaaaattattatttgtgcagttgacaacatctattcaacatgttccttaaagaaaaatctccctaagtctgtgctatattttgaactaaggtaactgataattgatcaaagcattcaactactatgatatgtgatcaattgcaataagacactgggagtgctttccggggtagcttaatgggcaatgacatatttgatatatgaaaaatcatactttttttaaaaagggatctaatagaagtatgcaatggtaagtgatatttttgaaagagaatatatacataaaagaccacaggtacgtaacaaaaatgaaacaattttgttgatttttaactagaactgtctagaaaaaatacatattgtttttgttatgcatctttattttttcaagctggctactggttgaatttctggcataataagcataaatcagccatcttcttgcctatctttggccatttattcctttctttgttttttagtgtaaatagcttgattccatgttttgaaagagcaacaacaaaggtctcaatcttgaaatctcctttgtatctaattgccttgctcttttaatttcctgcttgctgcctcttaggcctcttccgccacaaacctattctccattccatcatttcttacaacagtgcagtccacgatgttttcagtcctaatctaagcaaactacaatcgtctggctgctgttcctctaccatttttatggcccaccccttacatttactttcatcccattttcaatgtagtatcatgagccaaaaaaaaaaaaaaaaaaaaaaaaatttctttgcctttaattttggtaatttgcaaaaaaaaaagtatctagagtgctattttcaagatatatttgcaaatcatctctcatacattcaaatacttcgcttctggttggagaggttttcatataatatgatcctaggtattgcccatgaaatagcagaaatatatataattagtatgtataaatcatgttgatttaaaatgtatatctgaaaagtccaaaaatgtgatttccaatgtacgtaaaaatgccaaagagaagatatataatgactggttaacatacaattattggaatttatgaagaaactaaaatataaatataatgtttaaaaatatgtgatcatcatgcccctgtttttatgttatatttttaagattcttaaaaatacagaccaaactattgtaaggattttatcaagtaagacagattattttttgctctgataatcactttctacaatgagtgtcttacagtcacagatactatagcttgtttagtattttgaaatgggaacatctctagcagttttgttcatttgggtcacagctgtgccatctatttgcatgtttaccaaatggttactgaataacacatgcctaagaaaactaagcttttgcaaaagcttgttaatatttgcagtcctcaactgaactcggagctcacaaatgggctttttgcaaaggagcctgaattcttggcaatgcttgataaatgtcagtcagtttctttagccatctgcaaataaaggtatattagacaatgatgacttcataacagtcaaagatgtataataattaatccagggacacctgtgcacagttccttttacaaagctatcacagtgtattatactataaaaatcataaaggattttttaaagaacagattttatctgatgtgctagcaaagctaaagacgaaataagctgcactgattattggttatcttttacagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatatta

SEQ ID NO: 821 - DNA, 270739 bp, Homo sapiens
gaggaggggggtgctcgcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggtgagtgcgcgggcgcctggcgggagccgagcggtgaacgtgcgcggggacggggtgccgggggagggcgctggccggggtcgctccgagaggctcgggctacgagcaccggtcctgcccggggtctgtggagctggttggctcgatgagggagggaggacgcctcttggagagcgctcatggatttgtgccagggtgtgtgtgtgtgtgtaaattgtgtgtctttgttgtgtgtctgggtgagggtgtccgggaaggagctgtgtgggcagaaggtgcgggagtgtatttagagatgcaagtgtgtgtgtgcgtgtgtgtgtgatggtgtggggtctgcgtgtgagtgagcgagggtctggatgggtgttagagtgtctgtgtcagttacatggagaaggtgtgtgtgtgagagtgtgagcgaatgttggggggagggtgtgaacatgtgccaccttccctgtgagggtgtgaagtgtgtgagcttgtgtcactgtgggtgtgaggtgttagggggtgggtatgtgaggtttggcgtttcacgtgtgtcccgagtgtgcaggtctctaggggtgtacgacagcggattactatttctgtgtgcacaggagatgggactgtgacactggacaagagtctgcttatgtgggatgggtgggggtgcaggtgcctgggagtcgtgggcttcatggggctgggagtgtgtgtatgcgtgccatggagcgtgtggttatcgtgtgcagggaggtatggacgcttccggggctggggagttgtgagcagctcagtgtgtgtgtgtgtgtgtgtgtgtgtgtgtcccgccgtgtggacttgctcccgggttaggctaagacagctagaaggaggttgaagccgagcgggttctccggagccagtgagaggtggctccgcagccccagggtccgcggccggcctcccacccagtgccgccgcgtagtgggtcttaaatggagctgaaccctttcgcgcagtgagcagagagccaacgtgaggctaaaagccaggagggagggaggcgggaccagcgaagagccgcaggcaccgagactacaggctccgcgtccgggatcctcctcggagcctggtgccaacctcagcctggctggagtcagagcctggctccgcctcggaggggagcgggacgcgaggtgccaaaaagtcgtctttatgatcaataaggtctcgaccccgagccccactggatgatagaggtgggcatcacctctgtcctatgccatagccttgtcccagcaggaggtgcctacctaggctctgagagtgcctgccaggaaggggtgcccccttaaaaataaccccaactccttctaccccgaagtccttggggagtgctgggtctgctgatgggagaagctgcagaatttgagcccggaaggtggtcctgacagcgaggggggaggggttggtgtaacccagaaggaatgcaaaccctgtactttgttcccctacccttggaacaagagactttcctaagtggatcaaaatgtcccccctcaactttgggaggagggctctagagggaaaggttacatgggggaggtcctcgttccagcgccgccgagagggcactggggtttgttgaaaggcactggagccctcacctggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttcacgaacgtactggcggtcactgctcggggaggggcacggccagaacgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagccgggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgcagagaatattcgagctggagcgacctcggagatcactcacttcggtggttttgaaacttgtgtgtttttctttttcttttaagtaggaaaacccttttagaggaaacattatcaccctcctaaaatcccaataccttgagcaagatgatagatcttaaagtaaagctgccctggtggatgctggggatgaggcccacatcgagcgctccttccacacaagtctttcacaacctcaagactgctcccttcctccgcagctagtattgtagctggggttttgtttttccaatagccccgattatatggatcagctgcgatgtgtcaagcaggatgctggctgctgcttcgcagtcctcattcatgctgcaagatagatttaagaccttcttttcacagattaggaaactgaggttctgaggtttaagacttgttaatgacagaagtacaggctccttccgctccctcctagttctgccccaggctcctctttccgctgaatcttcctttcctctctctggccgcaaagaatcccttgggcagggcatgtgagtagagaaggacccaggtcatctgagtgatgcctcagatctgcctgctactctgatatttcagaacgtcagtcacagacacacttgaacttcactacactctggcaagatgggcagaggacggagtaggggaaggaggtggaggagcttaggggacttgcttagttaggtgcctggtttatagtggtgtgtgacttcaaaggcagagaccgacaaaatagaggctgtttagttctattaactgggtttcctgggatctgtagaggtatttaacctaggcagttgacagcctggcttaccaccttgcccgcctccgctatagccccaggccaccaggaattcatttattcatgcatccaacaaatgcttattgtacactatgtgccagacacggtgctgagcattgggaaaacggccctgagcttggtagaggagtcccctgcctctatggtgtttaaggctcagtgggaaattgatgcttcatttagagggaggaaggggctattatctctctctggccctaactgagctaggtgtcacgccatgtgctttatctttcttgtcttacagaatccttacaagcaccctgagaagtaaaatgaagtccattttgtagatgaggaaactgaggctcagagaggctaggtgactttgccaaggctgcagagtcattgaatggcaagcaggaattcagatacagggccctctgactccctggcctgtgcttcctccctccatgctctgctgtctcctggtgatcatttcctgagccccagccacatggatgtgtccagtctcctgtctggatgcctgactccttcccaaacccacactgaaatagaatcatccagggtgttcatctgcacagatgggagagggagtgtccctgaaagctattgccatcaccaagagaatgaataggcatctgctgtgggcagggcacatgtgaaaagagcaaggcctatgagtgtgatcctcatcccagggcagcgagagactgggcatgtttccgaaaagatgaacgacaatctattttgtccatcctccctctccacctcctttcctcccccatccactcctgttcccttcctctcttttttctttttgccttcttttttctttttaaataaaaggaggttcaggatcttttgtaagtggaggaactgggagtttcaaaaccaggtctgaagcaatccagagacagctgctttttcatcactggaaagggagtacagcagcccttactacttgtaggaggctgcaaagctgttcatttcaaatgataaatgtcagtggtggtaaaacacatgagatcacttcctaggaggtgtccttctttaggatgaaattccagggaagattggggtggtgagatcctggaacccacctttatgctacagtgagctccaggagtggagggggctcatgttcactaagacccccggctaagattccatggatggagcaataaaggtagtgtgtatggggctggagatgcaggccctgttcagtcacctctgcagcccaaaagagcaggagagacaggtcgtgggcagggtgtggcttgggggtggggtttttctgagacccagactttagtcccctcccaggaaaggaatctggtgtttggtttttccaccagcctttgttacatcttctggccacatactaaatttgctttgggaaatcacaccaaccccgcaccccacccccaccccacccaacacataaattgcatgacatcttggtgggtgaaactactgggtaaggcatccccaagatgggccctggaatctgaatattgagcggagtgtcacaaagactgagagacactagaatgtcccccttgcccctgggacccccaggaaaccgtcctttgttggtttcctgagactgataatgatgggacctatctcccagtgtactgagagggtggaatcaggcattacaagcagagctcttagctcagtcccgtgggctctgatgcttgttactagtgttaaccatggtaacgatgagtacccgctgaagcagccccagtccttgcgttactcgactttttcgtagtgttctcattggttacattttttggcttgagagtctagtgtcaatttctgctgcttgcaaggaaaggatcccatgtgataacctctctaggtgtgatgaccagtgccagccttggagttgccagtcagtgcactcttggtaatgcacagaggatggttcatggccctctggctgggggtgaccaatcccaccgcctgccctctgtctttccctggagtcttgaggcccattgagtgcagtgtgagactcaagttgttccccgctagtaaaatgtacagatggaggccaatcttatagtgaacttccaatcccctgacccactagaccctgctccacccaggcagggaccccatctggttctgttcactgttgagtcctccacaaaacacatagcaggtgctcagtcaggttgtttgtttgggtgattaggctacctctggccttgcgacatgtgcaacctggttttgaaaaagactgagcatgtggctttctatttctatggaaaattgtgtgaaaaggcttatagcatgtggaattgaggctggacttgcaggtggacttcctggcagcaaagatgttctgatcctggaactacattctttctttctgcagtttctcagataaagtagcagaggccctgactagatatcttaactctctacctgctggcagtacttgaaaatgcacaaaacacttccacgcccattattccatttagacctcacatcacacagggagacagctagtcttgtacctgttgaacagatgagggaaaatgaggcccaggaagatgaaaggatggcagtaggcagtggctggactggaacccagattctgtggttgcgagctcagccttcctcccatcctcaacccattgctggacttcatttagccacaggggtctggcatgagacaggtcagtttcccatgtgcttacaggccagtaagctttgacctcaagtgtgcactgtgagctgtgtgctgctgtagccactttgctgctgtgacttcctctatcctccactgctgtccaggtgggtgttatatccccagtccacaggtgaggacactgacatgcccagggtcacacagcttgagacaagagctcactgtctcccctgtctccacagtcttgtcctgctcagagatttctggccttagcttctccatcctccacctcctcccccacttccgccctttcttggctcagagagcagacatctgccctcagctagcacagtccctggctccccataaggctttctccaagtttctgctcacccacatcctccctccacagccccccaccacacacacacagactcaggtgtgccctaagcatgttggcagcagtacttttggcaacactttgaaagcagccctccttggggctggagatcgttggggatagtctccctcctgaacagagctattgagggtgagcatctctgcaccctcggccctggcaccaggcctggctctgagcacatagatcctgaagatgtgtttgttgaatgaatgaatgatgtctcccctgagcctgaggtttggttcaaacaccagacccaggcttgtttcctggccctgctcagttgcctctggaagtcctttctggtgtgagaatgtgtccattgtccttctccattccatggaccacagtggcatcacagctggcatctggaggaagggccaacactgcaaggtgatgggaagaccaaggggacttcgtgtcccctctatgttctccttggagaggggactgtcctagatgggtgatggggatttgggaaggtaaagaaagaaggaaggagggaggaaaggaaggaaaaaggttgagaagggagggaggaagacaggaaggaaggaaggaaggaaggaagaaagaaagaaagaaagaaagaaagaaagaaagaaagaaagaaagaaagaaagaaagaaggagagggagggagggagggagggaggagcaagcattcaccgagcagctactatgtgccaaaccctgtgccagacatgttcacacataacatcatactcaactatcccagaaatgcctgtttgggagataatattctccccctttacagatgagtaaagaggcttggagagattgtgtgacttgcctgagtgaggggcagagccagattcacacccaggcattgatttgcacatctcttcccaaatctgagtttctcccattggtagcttgaaatagaccattactggagtattcacacaatggaaatcggcaaactatacattggggcctccctcacccgagaattggttgttacacacttgccagcacatccctgggtatgcccatccttcctaatccctccctgtctctgtggggcagccacctgcggttaatgtgctttggtttccatctgcaatgggctcctgttgtccaccacttcctaacaaagtatccttgggcaagacactcgctgtctgagtcatagtttccctgtcttttaaaaatggagggtgagtgagatacagcaataacacatgagagcttttggcatgtaactggcctctcccttcctcctgatggggccagcaggccatggagactctgaggagagtggggtcactgtttcttctccctctgctggagctgctttgggcgagaagtccacgatccagtcacttccattaattaagcagctgccccaggcctgattctggactgacagagacctctcggggagtttcaggttgtgggcaatcccacattcattgagaacaattaaaaatcacatgtaatcaaatggccaatacagggcttgaaccaagcttatgtctttggggattaaagggagtggcccaggaaggctctgaaggattgaaacaatcttgccaggtcaggagtggtttccaggcaggagaaacagcacatgcaaagggctggggaagagaggggaatgccatctgggcaagtgagggttggagctatgaggctcctggccttgcttaagtgcaggtcctggttgagaagctggggaggaggatggaggagttggcagagacctgcctgctaggaaagcggtctggatttgagcccatgggctgaggggaatggtttaaaagagtggagtggcattcccagagcagggctctaggaagattaatttggcttttctgggccacctgaagctggaagctcttttgaacctccactgggttataaatggttgctctgggttgcccaaagaaacgatggactccagaaagaaatgccatcgtttggagatggcccacttctcccagcacatcctgacccagtgaggagggaaagccaggcccttgcccaggccctaccaagattgcacagccttgaatgagactgccccagcctgagtgtgtaccttgggcttgacccaagagtgaagggaggaggagcgcggtcctggggagaagcttctagatctccaatgggcatgggctttgtagtctaaccagctttcagattccacctccaccacttgtccaatttgtggactcaagtaacctcttcattattttacccttggtttcttcaaccgcacttgtcactcttcatggtggcctcgtctggtgggggctgctgggaagcgtgaatggataataccaggaggccatatgcacagtggctagcatacagcaggtgtttgaaaagtggttgctcccttgatgatgtttggctccccaccatgtggtaggagcaccctccaggtttgaagggaaagaagtgtttataacccttgattcccaggaggagaggatgcatggcaggtttccccatgtggatcactggaagaacctttgggtttggaattacagagcatctgagccagaagggagctgggaaattatctgcactgtctcctctctccccattttacagacaagaaaactgagcccagagagaggaatgagtccttctttgttgcatgcactgagcatgatgtggggggcaggtcttctccttcaatgtcagggacctgtcccagggcttggccaggtggacccaccacctgaagagcctggcatggggaagcctctgggtcccctgaaattgggtggggaccttggcagcacttcagtagggagcaacccccagcctcctacatcacaggacagcttgggagtcgccacggagagaagcagctgagcctttggggtttttttttgttcctttgccaagctgttccctttgcccttttgtttctctttctacagaggcgctcagcgctcctctgatgggcttgtttgtcaccagtcgttggtgcttcctttatctccccagcaccatctcttcctccttttttccctaacgccgccccaaaggaaggcgttcatcacaggctgccctggcatcattctgggctgggctgggctgggggaggggcagcacaagcgtccgatacactggcagaggctggggcagctggagggtgggtagctgtggcatcttgagctggtgctcaccgcccgagtgctctggttttgtcgagtgggtattcagaccatacaacagccaagagctgaaggaaggccaggtgtctggttctacagaagcaggtgatgagttgctaattgttacccagcacctaatgtcccaggcaggggcggaaggagtgaggtggggggcggcaaaggcagtcaccccacaaagacttctttgtttccgtctgcagcagagaagtgggtctgatctcagcttggaagggaagaggcatcagaaggccaattcctagggcctgttgcctggctggggagcttttgggaaggtggggggaagaaggacaagttaccccatggagagcatgggggttacctcatggggaagagttagtcattcccaggccagtctggcttgcagaaagcaacttcttgtttcaggaagcaatatagtctcttcctccctccctcccttctttctttccttccctccctccctccctcccttcctttcttccttctttccttctttccttgtctgattgaggaactgaattttgttgaaatcagctaaatagaagctaagacaccttacttagttttcatttaaacatcagtagtcacacatggctatgtattgattggaacagtgcagctctagactgtaagccctaggagggcaagaacttacctattcccttctttccttcctcccttcctcccttcttcccttccctccttccttccttctctggctcttgttcatttatgcagcagatatttattggatgtttcctgggggtcaggcactgtgttgggttctagaaatccagaggagggcaaataggcaagttcttgccccactggggcttacagtctagggctacgctgtttcaataagtggccatgtgtgactactgacatttaaattaaaactaagcaagttttctcagcttccatttagctgaattctacacattcagttcctcaatcacctgagtcacattttaagtgctcaacagtgattggcggctagtgatgacggtattggacagtgcacttccaaaagctctactggacagcactggtctaggacaatgttcctctttgggtgtggcatgcccactgacaggaagaaagtaacaaggaatcatagcaagggggtggctttctcttttcctttctcagattgtccttctggctgtgccaaggagaaggtctcaggctgatgccctcaagctttaatgcccctctatcacatgctgatttctttccaacataaagataataggtctggggcaacaagcctccagcgagccagagggggcaaggcttttaataacggtgtttttttttttttcattgtaattatttttcagtcactctctgtttaaggcaactggtaccaatttgccatttggggcagtgatttaaattctccctcttttaaaaaaatggctttatttaagtaaaaaatgagtcaagttaaaaatgttaagtacatagtggagcaggtggcatgcagatatggccaatctgtgaaggtggtggatgtgaatgtctgcagttagaaacctcggttcagatggaaccacatgggcttctggaggcaccaccatttctatgttctgtgatccggggaacaagttacttcagtccttatcaatcaggttctggcaggaaacggcaggctcagcctggagcgtctgaggaggacttgttcaagggactatttgcataggatttctggaaaaccgcaggggatggtgcagccccttggagctagaagagtggggcactttctacctatagcttggaggagtagatgtaaccagaaagcaggctgggctgtgccaagaggactgccagacagccaggcggccctgtgtagaggactgcagccaactcttgggggcctggcaggaagctggagggagaaataccccaactttaccctcttcctgcctttgggtcccttgatggtgccacccattgatcaaaccctattgaaagcccatacagatcagcctccaaagtgcagagctggtagaaagggaagagaacgagctggggtccaagtagcagagatccagcacaattctgctaagcctcagtttctccatttatgaaatgctctacgatgctcattgtacctgacagggttgtggcgatggtgcaatgagacaacatatgtatagctaatgattggtagctatttatatttataacaacagcagcaaaacggtgcctactctgcagtcccaggctccatggtagatttttcctgagctaggaagtagcatatgagaatggggttttagggtacaaggtggaactggcttttcggcagcatgtgaatttgaaggggcagacaacattggaggcaaattgcagcttgcaaagcggaagcactagcgctctccacaggctggtattgacctttgcagtgtgtccttcctactctggtctcttcgacatctccacatctcccctgtgccctagtccatctcactgattgattacttcaccccagggcttacctattcgtcattccccagtctattttccaccctatttcacacggagacgttctttctccttagatccatttaggtcatctttccaccatccccactggctcctatcatgtgcagcctggtccacatcagttatgaagaggctcaaagctgtctccttccaaatggaaggcaggtactctccaagcctcagctactcctgccagaggctactttcacccttgcagatgggggaagggaagatactcttgagtaacttagcactttggaccactggatctttatccttcatctgaaagctggaagtgccattgccacttttagagggacctaaaggagtagctggagctcagggagtagctggcttctacgtggagataaatattcctcaggaaaacttccaccggcagtcctcttagctcccagctactaagttggctgaggtggcttttctcacgatcctctatttccctttgtccagccccttttctcatctacctgactgttgaaattgactttgatgaggactaattttgtccgttgaaattcatgagacgcttacccatttggtgctttgctgaaattgccgtgacaaataccagtggcaatttcttccctggctcattctctaaagtactctgggcaagacagagtgcacctgccctcgccgacatgccatctgtcggatctgccatcctccaccagccctgctgttggccctgccccgatgcaggtccatctcagccattcctacgtgctcagtggtgtgtgaccctttaggaggagatgggttgcctaagggggacaaatatgccttagggggaaaaatttcacccacacccccattggctctcaatgtccaagttggctgaggtgatattcctttacccagcccctgttccatgtacccgactgtccaaattgcctttgatgaggactcattttccagttgaataaggggacacgttctgtaggccagtcctccatcacaggcaggtgcaccacttctgtctccttgagccaggtcctgggtcaccaggatggctttggtcacccatgagtctcatttgcctgggcggtaggggtactgccttatggcttgtgagctccgaatccctccctggtctgagcctggacacactgcagagattgccaaagaaacctcagtcaccctcttcacgacttttgtcatgtctatgtctcatctgtgcttttttcttttcttttttctttctttctttcttttttttttttttttttttttttgagatagagtctcattctgttgcccaggctggaatgcagtggtgcaatctcggctcactgcaacctccgcccccagggttctcatgcctcagcctcacgagtagctgggattacaggtgcatgccaccatacccggctaatttttgtatttttcatagagacagggttttgccatgttggccaggctggtttcaaactcctgacctcaagtgatcttcctgcctcggcctcccaaagtgctgggattataggcgtgagccaccacgccaagccaccccaactgtactattttttacaccatcattttcttaaaatcaaatttcaataatggacttcttcttttttggcttgtctggttccagggaataatgtatgggtttgttgtattgactgtcgattttttttctttttttttttttttgagatggagtctcgctctgtcacccaggctggagtgcagtggcacggtctcggctcactacaacctctgcctcctgggtttaagcaattctcctgcttcagcctcccgagtagctggcactacaggtgcatgccaccacgccccagctaattttttttctgtatttttagtagaaatggggtttcaccatgttgcctaggctggttttgaactcctgagctcaggcaatctgcccgccttggcctcccaaagtgctaggattacaggcatgagccaccgcacccagccagattttttattaattcatattaagataaatatgtgagtatttgaaatttttgagaagcttctctcataccatcttagcatcagcctgtcagctgctttggaaaataccagtttggtaggaagggcaccagcctagcagttttggaccctaggatctgattttaacttctccattaatttgctgtgtgactatcccactctcccgggtccgtaaaatgaaagggtgagtccggatgatcccattctaagattattcgatgggcaataggatttagaaggaacaccccacctatgctcaaaatattttttaaagactaatttgatgccttcccagcttcctgcctctaggatgaagcatctgcctctagagaaccctggcaaagaatagctgtgccagtgacaagggatgctccatttcctgggagcataggacagagccttattccagctccagtcagcagccctgcaccaagcatctgctctggctcgggccttctactagggctggggctccagagacaaataagacccagtgcctgtcctcaaggaattcatagtctcttggggctgataggcaggcaaacaaataaatcatggcataatattggaaattctaaggttgacataggtaccaagtcctagggagagtgcagaaaagggaatgcttaatctgcttgaggtgtggaggagagtcacagatcactagaaggggtgatgcatgactgggtcttgaaggatgcataggagtttgccaagtaaagaagggagtggagggatctgagcaggatacaacagcaaggataaaggcctataggctggaaagggcctggggcacgtgggagagtcgggaggcaggggtgaaggatgtgtattgcaggtaagaagtgaggctggaggggacacaggggacagatgaagtgcatttgctggaggtaagccagtcctgcaattagacaaattccctagctgtaggccccctggcccactggcattcacggaggcctggactctgctggccccaccctgggaagcatgaagcccccctttcccactgaaaatgccactggtgctgtttgccccatgcagacaggaagagcactccagagggacagggcttcagagcaagaagcagaggttggtcttttgacaaggtgctgcctccttctaacccaggccctgcagctgcgacagccacactagttataaagcagcccctctcggctatatggatccagagaaacattgaagccaaaataggggtgtggccaggtccaggctctcttcttcctggacctcctcgtcctcacctgcaaagtgataacagtagcaaatgcttattgaacacttgctgtaccccaagcactgtgacaagctcctgcttgtattacctcactcctaaaatctttgcaaccgctcaggaggtgcatgccactagtatcctcattttacaggagaaagaactagtgcagagaggttaagccaccggctaaggggttgcgcagcttgtaagtggccatgctgagttttgaacccatttggcctgcttcctgtactctctgccttcttgcttctctgcagaaatcccttccaacttgaccttctgtgattctgaggctgcttggacttcccatcctgaccttatgtggctcttcgtgtctcaggggctccagctacagctggaggtggccccggaccccgtggctgggctgctgtggaaggtcacagggctgcccttccctgcctcggcagtcactggatggcagcttggctctgctgtgttgtctctggcctcgttattattattacttctttccagcatgctgctaaaagcttcccgcagacaacacacaatccagctctttaaaatttaaagggctttacttaaacaatgttatttccctcggaaaggagacagaagaggcatatgcgatagttatatttagtgcggcgtgtgggtctgagcagatgagtgtggtgtttggtgggtgtgcaagtgaccagggagatgtcatccatggtgatggggccagggcaaaggcactcgaggggaagatgtgccgccagcatcccctccctctccttccccagaaagtgtggcctcagagagaaactactgtgcaacgttctgggaagaagaggaggatggttgccatctgagggactcactggagagacataaaactggacaggaggccctgtccccctgccacacaggctctcagcactgaagacacagcactcccagctgccccagggcctttgcacatgtggttcgaactctgcgggaacccaccttcttctttggactatatcttcttcatgattcaggtctcatctgggacatcacttcattcattcaacatgtattttctgtgtacctactatgttcacaacaccatggggcacaaagaccagttgtgactcctcttcatgtcccctgagtctggcacaggtcctggtgcagggcaggtatcagtacatgtttaggaaattaccaaggcctgtgtggatgctctggggtctggaggacagatacggctacctcgttggaaatttacagcagagacatcaagaactctgaatgaactgattaaagctggcagagccatacctgctcagggaaggaagggagagttcacttcctttctcctttagtgcatctattgattcattcatttattcattcaactcatgtttattggacccctgctatgttccagatagtgtgctgggcactggcgatacagtggtgaataggccaaagataaaaccttccctctgggagcttaccttctagagtgtgtgaccagccagctaacacatacgtgaacagataacgtaaggaagtagtaactgctatgaagaagactaagacccagaagagtaatggtgaagtgtgggggttcaggattgggcaggggccctattgatggaatatctatgttccagaccctgcgcaggccttggggctgccaagaagtcaagaaaggtaatcaacaactacaggaaatgttcaggaaaaaggaggaagccaggataacccagttagtagtgaccaggggaggcttgctatcagggaggacttcggtgaggttctgagagctgagtggggccttgaaggatgggaggccataggcaggacttagcagccggcctttggttttcaaactgtgctcctttgaaccccaacttcccatagaggtgccccaggggaccactttgggaggcgagaatgtggctcaagatgatggttgagggggttctcgtgccccaatcaagctgagagctcgctcgctttggctctttcacagatggggcttcagttccagcttcactttgaatgaaaataaaatagccaagaaaaggaatttgaaaatgagtgggctggatgatggggaggaagtgcaggccatctgggctgggggaggttctggagattttctgcttggttccaccctcctttcctccacatgtggggaaactgaggattagagaggcctttgggttgtcccaggtcatcagcaggagggggccagatctgggataaatgcctctgacttctgcctctttccaagctgggagggaggcctgtgagaaagcccaccttgactctgaccctggacccgaggctcacagctgctgttggggatcctgactgcggcagtgcccccctacttgtggctcctccaccccaagcccagctgcaggacaccccttctgaacctctcctctgccagcccaactggcctgccccaccctcatgggagccctgaattaaacgaaatattttatgatcccatgcttcgttatgttttattaaaagagctggtgctggcttccgctggcacagctgctgggcccagtcctgaggcttcctccccccacaccccctccagagccgacagctgccacccatcctccacccctaccaccaggaacagccagggtgtcaggtgctgatgagatgaagggaaatcctgcaggtggggacagattggggaatttggaatgataatcctgcctggtgttcacacatcccattagatgcccctcaccctgcatttctgaccctccccacgtaccccatgcaaatacaagcccaggctgttgtcccttcccaggctgctcatgttccatctaccagtgaccacatggaactccttgctctcagctaagtcactggctagatgggtcatcttgaacagagcacatgaccacactgagcctcagtttcttatctgcaaaatgggagttggccaggtcaggcaagggctttggcctcatgggctgacattctggtggatgagagaggaatgaacatacagatacataacctacctctggctgtggagctatgtgaggggagtacagcagggctgtgggatagtgagggactcgggagcagagcagcttctctagattgggtggtcaaggaaggcttcttggaggaggtgccctatgacctgtcagtttcaatatggaagtcatgaggaaagagtcctggcatctagatatttctggtggagaagcagtcctcctccggacagtgctgtgtggtatcagggccacgtggagaacttagggtggggcctacttaggtctgaatgagagctgagccacctgctagatgggtcatcttggacagggcacgtgaccgctttaagtctcagtttttcatctgcaaaatgggggttggctgggcactgtggctcttgcccataatcccagcactttgggaggccaaggtgggcagattgcttgaacccaggagttcaagaccagcctgggaaacatggtgaaacctcatctctaccaaacaaataaagaataaaattagccgggcatggtggcacactcctgtagtcccagctactcgggaggctgaagtgggaggatcacttgaacccgggaagtcgaggttatagtgagccataattatgccactgcactccagcctgggtgacgtagcaagacactgtcttctaaaaacaaatgggggtgaagctgaacatctttgcccaaagcatctgacatccataactatttaattcacggtgggctccctcactaaaggagagagggcatttaatcaggtcttcattcaagggaagagattagtgatactcttggatattattattattgttgttagctaatactaatggataacttactactcgtttatccaatatttattggtctcctactgtgtgcctgggaggtggttctgaacaggaggcaagagctttggctgcatgggctgacattctggtggatgagacaagaataaacatatggataaataacctacttctggctgtgaacctctgtgaggggagtaaagcagggctgtgggattgtgagggactcaggagcagagcagcttctctagattgggtggtcaaggaaggcttctgggaggaggtgccttatgagatgagtagggaagaaaatagcaggaaaagtctggctcagccctggtgttggcgtctcctggccagggcgtatgtttgtagctgattccttccctggatggggccttctctggactctgaccccattgctgggaatctgtcactggtaattccctcccaccagtgatgcaagctcagctggcccatgacagtgtcccctttggccctggggagacccgaggaaagagcattccaggccccagggaagcaattctagacctgttcttatttaattcttgcagaactccacgtggtgggccctactgtattctccatttgcagatgaggagactgagactcagagatgaaactcccctagtgggtttgtggaggagctgggatttgactccatcactactgagttagccactgtctcttgctcattcgctgtgtgtgtgtgtgtgtgtgtgtgtatgtctctgtgtcacatgggaggatgatggagggaaaaagcccacccctcacctccttttatttcaccttgaaccccaggatacctctggacagggttggagcctccagcgcttgggtgagtgggctgagtggcctggagcccacagagtattgatggctctcaaagctggcaggcattgggaggcagaaaggtattaattagcagttattccccagcagtggggagatggatagagattaaggtggcggtccgtgcatccgttttgtagcagctgaggagcaacagtaagtcagtgctatgaatcgatactgtaagagggagatacgttttaatcttattagcagtatagcgttatggggagagaggcaggagaattcctcactcaaggtgcctgggtcaggaaaaggggagagagagtaaccggggcttggaccatctgggagggcaccaggatggcaaattttactcaggttgggaaaaggcaacgggcagggaaatgagaggtgggagaggaggtgagaggcaggaaaggagtgctgggtcagcagagggggacccttccagtcttcccaagggtgtctgtcatggatgcagttctctcatgtgccccctctagctcctccccatgaataagggctctgagttggacattggttcaaccacgccacctcgatgagcctctgactctggcactggcccttctgaggttattggcctggccatgccacccacgggcaagactcagaggctgagaaggggtcagtgggtggaggcatacaggccagcactgtggggctggtgaggagggagccatcatggaaagcagcctcagcaggtgcagtctcgtatcgacccagcaacccctcatggtaggcatcttgtccccatgcacagaggatatgttgtgatttgaatgtctgtctcctccaaaactcatgttgaaatttaattgccattgtagcagtattaaaaggtgggactgttaagaggtgattaggtcacgcgggctccacactcatgggtcggattggtgctgttatcaatgggtgagtctggcccctcttgcccttccgcgcgccttccaacatgggatgacacagcaagaggggcctcgtcagatgccagcctctccatctttccagcctccagaaccatgggccaatacctttctgttcattataaattacccatgttgtgatattttgttaaagcagcacaaaacaggctaagacagaggggcagaggtgcaggaggtaaacagacttgctgagtatgggcggcaccaggacttggtcctacctctgagtgacaaaagcccagtgtccttctgctctaagcactggacaccaccccccaaccccatcccacaaaagccgtgggaaaccctgtgaccctgtgaggtctggcctttgagtgtgacaaggggcttagaagtgagacaccctcttcttctctttctcccttgctttagttcaactcttcacaccaggatgagaagttcctgtgggaagaagactgggaggaagagaaaagacagaaacggagcagtcaggatgaaccatgagcacctaccattctgttccacccagggcaaggggctggctctctctgggcctcgttttccttaccagacctctgagggctcttctagctagaacattctctgattctgtgtctctctcttcttaaaccatcagttgtccactgtatcatgtaatcctctcagtagcccctgtgacataaacatcattagccccattttcaggataggtaaactgaggaactcagaaagggttagtaactcacccaaggttacacagctagtgagtgtcagagcccggattcaaatccagatcagctggctctcaggagctcagaactcttcattacacagcacacctccttgtctgaatatcaggacatttgtggagaaaaaaaatgttacctgagaaaaaagatgactccagaccgcttgtggagagcagcagccctcctacaggtgtgcaatggaccctcctgccactcagccacctcagaatctgtccatgtccggctgtccctgttggcccccctgctctgatggctgagccagccctggagaatacagctctcacagcctgtatgggggacctgagtgcccctcagctctgacagcctcgggccggctgatggagatgtctttgaggtccgcctaggcggctgaggacagagccaggcccgagggagctgcatgtcttgacctcctcatttcctctatccagggaggagagaatggagctccccgtggattgagaaaaacccctccagaaagatggccactgctagaggaaaggggtccagctgaggcttcctgtccctgcttggggaggggcatacctgaggcagatttttgtttttttcttcacgtgtctcagaagcagaaaccacactggtagctcagacataaactcccaaccctagcttctgaacccagaggttgatgaagacatcgcttttccatcccagactgattttctcatctatacctccagctaggagcacactgtcatataaagtgaacggatgaaggatgtgggaggcagtttcaaatcctggcccaccgcctacaagctgtgtgatgctgggcaagttacttcacatctctgatgttatgacaattaattgctacatgtaattgttaagaatcaaatgacatgattttatctctttgttcacttacagaaaggtgtgttataaaatttaattatattagccatggtaacacttgttgctataacaaacccccaaatttcactggcacaagctcgatagaagtttatttttagctcacatcacagttcactgaaggtatctctgtaggcgggtggttttcctccatgtgctgactcagggatccaggcctccttctgtcttgtggctctgccatcttctggggcacatagtcctttccaggcagtggaagaggaaaggtagaggactgtcttctacttcttataagcctggaagtggcacatgccttctccttatggttcatatacaaaggtcactggccacacttgcatacaggagagactgggaaatgtatcaaggtggtaggggtgggggttgaggggtggtttgccttccagagacaactctgtataatgctgaggaggagagatatgaatttttggtagccagctgctatctctactttaataaatacctcatttacttgcctgctttaccccttctgtgaaatccatgaagacagtgtttctgtttgtcttattgatcctggcttattaatttctgtaaccctagcacctaacactgtgctggacacagaatatgtttatccaatatctggatgaatggatggatggatggatggatggatggatggatggaatgatagtaaaccaaaccacactgacctatgacctatgacctatgacctatgacaaacacactgacctatgacaaggtcatatctatgacccatagatttgacccatagatttcccctggatttatggtcagccctgtgggcatagggccctgcctgactcattgactgtcagattcccatcactgagcatggtgcatggcaaaaggcagcttttcagtgtttgttgaatggaagccttagagaagacctttggaaaggtcagtattagaatctgggctcagcctcagcagccccagcctgtaggcagagggatggccaagatggctgagatatgagctaattcccacactgcaaaatgaccgcagagatttaccccatgattgcgttctgggtcctggccacctcttgggctgtcaggcaaggagggagggaagccccttttcttctccctggcaaagactgagagttgaaacctcacttccaggggccccacccaatccatcctgtgctcatgggtcccttggtgggcaagggggtgggggaccgctgctgggtttaacagggtctgcaaacttccccatgatgcccttaaaaggtgtcctgccatcccttaagcatctggcaagcctcctagcatctccctgttttcttgtactgggcggggtctggcctgtggggcagaaacagaggctctgagcaggtggagggagtgggggagggaggggacggagacagggttgagtgtcttcctttcttcttgccagaccagtgagaatttggctttaaatttttaacctaaatagagttatattcattctctctccctctagatgcaaagcacttttttggagcaattaaggaaaagcataaatcagtccggttttaaaagctcaggctgactttgtggattgctaaaattagcgtctccataaaggaagagggagggggaagggaaagctggatttggcttcaagatacccatgcactgaggctgggggtgaagccaggcctctggccccagccccaaccttcctgaggcccccagagcatgtgagccagggctccggttccatctcgcctctgctgagcagcggagcctttctggtctaacccccatgtcacggcttccctgattccaatttggcggaagacagtgggtttgcagagtggctgggtctgcactcggcttcactacacagccgctgtgtggccctggacaagtcgcttcacctctctgggcgcccccgcttctccatctgacaaatgcggctgtaatttacccttcatggcattgtccagtgggatcatctgagcaaatgtgctttgtaaatggacaggtgctccatgctgccgctttcaggtaatctacagcctcctccacctgactgcactgccagcccccttgcaccaccatctccttcagatcttcccctaccaacagtctgccccatggcacggagctcagaatacaaagtaaccactttcctcccgtgacccctgcctcggtttataatgacacgtcctcaggccaaatccttcactattggacaactgccgatccccgttatggggctggaagcctccggtggggggctttgttggcttggtcactgcaggcacgttgtaggggctcgtgaatatttacttgtggatgaataaattcatgatgaccacacgggtcagtgacttcactcctcagctttctaagcataaaatgagaataataagaatatttactttgcaggggagaataaaatgagctaaatcccttatttaagagatctttatcaagttttgataatgtgccaggctttggagacagcagtgagcagcatggggaggttctataccttcaggtagctacaaactagaggaaggtaatgtgtgttttagcacctaggagagtggcttaccagttactcttagtagaaccatgagtgagtgagtgagtgaataaatgaatgaataaaaggaaaaccatcttctgtggccccccttaaccctcctctgtggccttcccattacctggggagctggcatttttgctgtttagaggtctgattctgctgtcaccctctctgaattttccccttctgtaaggggggcagagaggctgtcatctcaaaccccatttgagctgccagagatgttctgattccttgtggacatggcctcagaagcttctgaggcagaaatcctataaccagccctttcctcctctggttcttctctgtgaccagctttgatgccagctcatctccctgggggagggttaattactcgcaggcactatccgctcatctcccaggcctcttatctgagacataagcatttaggcaaacacattaggccagagcagggcagagcctttggacaaacatctctgggcttttcctgggctgtggatgcacatgggcattggcctggcctcctcagtgcccacccccctcttccccaccacagcacccaccacaaagacctgtccagcccacaccttcagggtggacctcacaggtactgaaaaaccccagcacccaagcccaggtcctctgccccagggtccatgggcagtgagagtccactgtggctggctcctccccgactcaacctgctcagaccggggcctcagtcagttacagtgagacagagaaatcctacatagggttccacagccatgcctgggagattagaggattctctgtgatttagattgagcaacagatttttctggaggaaaagggctgctactgagcatatgctcactccaggccctgggctttgagcttccacgcacatcagcccacgccatcctcctgtcagcttagtgagctggggtattgagctcctgttacagatgaggaccccaaaccccaaacgtgaaatggcttccttcaggaagctggggagagaaaatcacattgactgggtgtttcctggggcaggctctgcccaagatgcctcactgacctgttgtattagacagttcttacattgctataaagaaacacctgagactgggtaatttatttatttatgtacttgttttatttatttatttatttttattattatactttaagttttagggtacatgtgcacaacatgcaggttagttacatatgtatacaggggccatgctggtgcgctgcacccactaacttgtcatttagcattaggtatatctcctaatgctatccctcccccctcccccaaccccacaacagtccccagtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggatgtgaactcatcattttttatggctgcatagtattccatggtgtatatgtgccacattttcttaatccagtctatcattgttggacatttgggttggttccaagtctttgctattgtgaatagtgccgcaataaatatacgtgtgcatatgtctttatagcagcatgatttataatcctttgggtatatacccagtaatgggatggctgggtcaaatggcatttctagttctagatccctgaggaatcaccacaccgacttccacaatggttgaacttgtttacagtcccaccagcagtgtaaaagtgttcctatttctccacatcctctccagcacctgttgtttcctgactttttaatgatggccattctgactggtgtgagatggtatctcattgtggttttgatttgcatttctctgatggccagtgatgatgagcattttttcatgtgttttttggctgcataaatgtcttcttttgaggaatgtctgttcatatccttcacccactttttgatggggttgtttttttcttgtaaatttgtttgagctcattgtagattctggacattagccctttgtcagatgagtaggttgcaaaaattttctcccattctgtagattgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctgacatgtaagtctttaatccatcttgaattaattgttgtataaagtgtaaggaagggatccagtttcagctttcaacatatggctagccagttttcccagcaccatttattaaatagggaatcctttccccatttcttctttttgtcaggtttgtcaaagatcagatagttgtagatatgcagcattatttctgagggctctgttctgttccattggtctatatctcttttggtaccagtaccatgctgttttggtaactgtagccttgtagtatagtttgaagtcaggtagtgtgatgcctccagctttgttcttttggcttaggattgacttggcgatgcgggctcttttttggttccatatgaactttaaagtagtattttccaattctgtgaagaaagtcattggtagcttgatggggatggcattgaatctataaattacctcgggcagtatggccattttcacgatattgatttttcctacccatgagcatggaatgttcttccatttgtttgtatcctctttaatttcactgagcagtggtttgtagttctccttgaagaggtccttcacatcccttgtaagttggattcctaggtattttattctctttgaagcaattgagactgggtaatttataagaaaagaggtttaattggctcgtggttctgcgggctgtacaggaagcatagcactggcatctgtttctagggaggcctctagaagcttccaatcatggtggaaagtgaagggggagcaggtgcattgcatggccagagcaggagcaagagagcaaggtggggaggtggtgcacacttttcaatgaccagatcacacaagaactcactcactatgcaaaaatagtaccaacttgggatggtgttaaatcattcatgagaaatctgtcccatgatccaatcaccttccaccagaccccacctccaacactggggattgcatttcaataggagatttaggtggggacacacatccacctgatccccctgatccccctatatcacctgtcttccttaatgctcaccccaccctaagagattggagccactgttattcttgtttcacagatggggaaactgaggctctgagacatgcagtcacttgcccaagatcccgtggctggtgagaggcagcaccatatttcatagctgggcgtgggaaactccaaagtccctcctttgtacagtgcaggacaaagcccactgaggaaagccactttggggggatggagacatagagaaagttcataactctaatatatttgcatggatttctaccacatatgaaggattttcatgtgtttatcatctggtgatcctaccacaaccctttgtggtaagcaagataggtatttatttaacaaatatttatgtagtgcttactgtgcgctgagaagtcttctaagcgcttataaatattaatgtgtgtaatctgcattaaaaactccatgagttagattctattattttctccattttataaatggagaaaactgaggcacagagaggttatgtagctgactcaaggccacacagcaagggagtagcagagctgggattctgtttccagcagatctgacctggcgatagaagccagggccatcttctttctctccctgtctttggcccaccgtgtccccagcaacaggacacatgatccatgctggggacacatgcagctgccccagggttgggctgaagataatgggttcgtaagtgacaggtgggctgagctgggattaacagagccagagacagtttgctctggagccccaagcatgggctacagaaccagtgagctttaagatccttatctcatcgaggaaatataataatccctcgcaggacatgtggcctcactttcttcatttccacagctttgtccagctgtttatctcaatccatccttacgatggcctgagaagtaagcagggaccagtggggtgttgcttgatcacttgcttctttggggtctagcacgggggaccgtattcctactactgctactgttattgcttgcttttggggttcccttcaaagcagagccagagagaaggatttggatgcaggggtttattttgggaatgaccccaggaggtagcagcaggagggatgtgggctgggaaaagaaaagcaactgatgcggttttcacttttgctctctcagtgagggaaccgctgacaggcagtgtgggacatactctgaatcacctggcaaggggcgaggaagctggggtactgatcctctaacccccacctctcagtgacctgccccacacatgggccaagtgctctcacagcagacttcttttaggtaaagaagtgcaagatgccagcttggcatctgctccctcgccaccaccattaactgagcacttactatgagccaggatgcccgctaaggcccttccctgaattagctaaatgtcttgtcaatggacattattgtcctctttttacagatgaggaaactgaggcccagagagagccacaaagagagtctgggagagttgggattcagacctgtcattttgtcttcaagcacttagtaagcacctgctgagtgccagccagtgtgcttggtcgtggctttgccgttaaaacccacatccttacccactgaattcaatgctgctggtgcaggagcgctcttccctcttgggtgcagagtccatattttctggattctctaggatggtcccaatggcaacactttttattcttttcaataaagataatttgtggtatatataaccaaatgcactctaatgtttaaatcttggtaacactttttgcatgaataaattcactcttcccttcccactgggagtgctgtgtctaatgagaaattctcatttgggctgggaaaatgcggtcgctgaaccagagggatgggagccggggcatctgactcaaagctcagggttccgggagctgtctacgtcacacgatgatggggccagttgggttcctgagcacctccccctgctggaagatcgtgcaggctccctgggcgatccatctcacccaccctcttcccagtgtcttcggcctcccagagcttcttgctcccattccagagcccagggccttcccctctgtcttcatttttcaccaccctctgcagtgctgtcgtcaggtcaggaatggaccactgtcaggcagtgtggctcagtggttatggtcaaaggctctgggacaggtctctgggtttgaaggccagccccacaacgtgttgggtgtgtgacctaggcctcattatctggatgccctaggcttcaatttcctcatctgtgagatggggttaatattgtagcagatgctgtcagtgcctggctgtactctctgtatttctctccacccgccaaagtctgcttactgtgaatgaaactcattgcctgaggcagcatccctggccagtgcacagggcaggccagaagtgcagagagctagggctcctggaagcagctctcaaccaaggacagacagggagttcgagaatgaatatcccaacttccttttttttaaaaaaaataaaaaattttatttagacagggtctcgctctgtcgctcaggctgaagtgcagtggtgcgatcacggctcactgcagcctcaacctccccagctcaaacaatccttgcctcagcctcctgagtagctgagcctacaggtgtgcaccaccgtgcctggctgatttttaaatattttttgtagagacagaggtcccattatgttgcccaagctggtctcaaacttgtagactcaagcgattctctccactcggcatcccagagtgctggaatcacgcagcttccttgctgttggtgttgatacttggaggtgtatcttctaccctgtctcgcctagttccccagcagggtggagttctagttgcctgcaggaaagctggcttaatgcacccagtatcctgccctgccttcctgctccctcactgatgtttcctgggtcacttcccgaataagctacctgcatctgaattattttctcacagtctgcatctcggggagcccaaaccaagcctcaatgtgcctagagtgggggcagctgtggggatcacatgggtgaggatctggaaagcactggaggcggccgcatatgcatgctccatggaagcgggcactcccacatcgtggctccagttccccagccagaccatgcttcacagtcgcgtgtctgctcctgctgtgccctctgcctggttgccttcccattcctcttcacctggctcatgccaagacatccttctggactcagctcagtggtcacctcttcttggaagtcttccctgactacgccctgtgcttggcttggcaggggggatccctcttcagcatccacataggctccttccactgtcatggcatttacacccaggattaccatcctctgcgggctgccccttctccccacttattctttgaggcctgagaccacatttctttgctgcccagctctctgggggaggaggtagcccaggtgtgaatcttgtacaccccttagccctctgctccctgtggcctttgacctgtgtctgcacacaggaacccagcaaacgtggcacaatgagggcttagcatccatctgaggagagcacgaccagagtgaagcaccccagtctccatgccttcacaaccttttctctttcctcaccacctcgggggtcacccagcaggacaggatgctgggacaagtggaactgaaggctgggcatccaggctgatgggaattggctttgagaaggaaggatcttaagctcaaggtctcatctagtcgggaggaagacagggaggaggagagagagagtttaaagctctgagaccttgctttgtcttgtttctatttattataatgactactgtcattattatgtaatgaggtgaatggtgggccaaagttttgcccacctgccaatgatgaaaaagagataggttgactttaaagcaagagaagctgcagtcagacaaaagaaggaacttcccactttctggttgagcagggttggctgtcatcaagttctcagcaggcagagaacttgctggaacacagggatgtagggcagggggttgggggagaggctgacacacagaggacagggaggatgctgtggatcaccagtagccactggggcaggaagaagcatatgactgagagtgagggacctggagagctaattctctgctctactctcaacttgctggatgactttaggcaagtcgctttacctctctgggcctccatttccttatttgtaaagacggggacaataatacattcctggacaacatctccagctgtttcacaagttattagatggacatacactttatacaatttaaagcacagttcatggctgggcacagtggctcatacctgtaatcccagcacttcggcaggccaaggcgagccgattgcttgaggccaagactttgagaccagcctgggcaccatagcaagacccccatttctacaaaaaatacaaaaatcagccgggcatggtggtgcatgcctgtggtcccagctacttgggaagctgaggtgggaggattacttgagccccggaggcctaaactgcagtgagccaagattgtgccactgcattccagcctgggcaacagagtgatactgtcgcaaaataatttttatatgtatatgtatatataaaataaagcacagtttggatgaaaaataaacaaaaccaaaaccaacagggtgaggagagaaggtgagaaacaagcacgtgcttctctttctctagcaatccgtatcaggacaaggggactccatttaatgaacaactactctatgactagcacctataaaggccttaatcctcacaacagcctatgtaggaggctcgtctccattttacagatgagaagactgaggcccagagtggtcaattaactggtccaaccgggattagaactcaggcctctctgactcaacgccctggcttgttccgcctttgccacattattggagctgtgatggtcagatgttctacccttacttgatcacctgatggttcttctccccctgcccaaaatgaagattaggatacaagacccaggaagtcttccctggccctcgggccctccctgccccttcccagatggccttggctcaatctgggacttcatcatccacccaaccaggcctcagctgagaaggagccgggctctgagcccaacagataaaatcccaagccccacagccaatcctcgtggcctggccaggcattaggcaatgctaattgcactgtccacagtggagccttgtttgcatatatgcaaattggggggctgattagcgcttcccccagatgggtcagttcaggcctctgcctgacccctgtactgcctggtttaaagcactagcgagtgggacaaatgcccatccagatgggagatgcagcaagcaggggcggcctgtggcctgggcagcccccagtggccattgcctggcagctgaagggtccaatcatgacctgagtgtttggatggggaaccagaggctgtggtcacatgttccccaagtccctacccaaagggtctggcctctccaatttgggggaccccaggatgcccagagccttccctgggccttctctcagggacaggactcatgagcctgaccccacacaggcctagtaacagcagatgtctgcggttcagcttccaaggctcccgcagatgagtgggcatctgtagaggaggaccctgggcctgcgtccttgagctcagccaggcagctgcttggagtgcagccgtgatttaatctcattgggcccttctgtcgggcctgggctcaggatgcggagcttcaggacttctgtgtgctatcccccaccccctcggctgtcccctttcaggccgggaccctcatctctaggctggatgacacaacagcctggaccctgatctcctgcctccgctcttcctctagacagtcccgctgagcttctcaaatcacaaatctgagcactctccctcctgcttagaactctccatggctccccagtgcccagtcataaagtgcaaactcccgtcccagcccatgcccatggcatgggtttctaatcctcgctttccttgtcagtgtccagctccccacaccacagacgccttgtgggggtggatgaagtcttgctggagaatctgttcccatggcctggcagagcctggctggactttcagaggctggaggaatcaccttcccagggaggcttcctgaatgctgtctgtgcgacccctggatttcgtgtctttcagaaagtcctctgcacacaggtgacctggtaggcccgtgccttcccttctatgtctctgttaaagggttctaaagtcccttctctgggcgaggtcttgtctttctgtttaggtgggagctcttaggtggtaggggggtgagtggtgcccatcagacttggattctctccccaaggcaggagctgtgactccccgatcagactgggacctcaccggggctggagctatgactctttcatcagatttgggacctccccagggctggggctgtgtctcccctatcagattaaggcttcgtgatggcagaagactgtctccctgcatcagagtgggagccccctgaggtctgtgtccctagaccttgtcacatttccaccttaggggaatgtcagtgtctactctgttccgttttctgttccttgatgtttccacgtggtcctctcggggaggaggcatgcagaggaaggaggacaggccagcaggagcctctgctcctcccatcttctccttccccaggcctggcccacagccccttcccaggacagagcagcaccttggtaagcctcagtcgagttggaaggattgagtccacaggcggctcacagacctccatgccccgctgccccaggctaggagccaagggccccatgcccccttggactcagttccccaggtcccacccagaggtagggctacccctagtcacctccctgcccaagctgcctgtgcctgaagcagctgttgggctctgcccctgaccctgaagagatctggcccacctttccttccatttattcctctgcccaattctgacctagcttagcctgggtccggaaccctctggaagcacctaggtccagtcctccagtcccctgaagataccactaggtagtactaggtgacttggtctaaccagagaagcctccagtaaatagagccccttagaccaccaagaaaagctgcccaggacccttcaaagccagagcacgttgctgatctgagaacggtcagccagaacctcccccttgtgtcagcagggccactcggacagagagggttgagagccagaccagaaggacagagtgagattcctgctggggcccttgttcttcgtgaccttgagtaagatgtttaacttctccgtgcctctatttccccatttgccacaacttgacgattgtggtgagaataaaatgagatagcagaagaggagcttccctgatgagtgattatgatgggtgagtcccgggtgcctcaaaaagccttcctccctgctgttttgaattatctgactccaaaagataactttttttattattattccaaaagtaatacccgaaagctggagataatttgaagcgtttagaaaggcacaaaaaagaaaatagcatgactcagagatgactgctgctcgtggcatggtgctgaccctgtcagccttttctgtgcgtggggacagggaaccgtggagggaaacagagaggaatttatggaatattttttaaaaagttatcctcggagtcatttttgtggctagatggctcctccccacctttgttccctgacccttgtgtgggtatctgaaagctgcccattaccctgttcttgccaccaatttcctcaattcacactccctataaaccaccatggggagctttataggcccacaaaggcattcaaagttaatggcaaaaccaaccatgtgaaaactccgctgtaaaatccacctcactctctccccagtgcccgagagcccccagcccctcctggttcccatgaggcagcctgatacctgccgccccaactggcactgggccctgggacagagggatgggcaggcagagagtccagggggtgaccttctttccaccgaggacacgaagcacacacatcctcttgccacaacaacacagatgcaataaatacgaggactgtaatttatgtagatgttttgaagtccaaacagaagggtggggagggactaataaaatgccatccctcatgtcggcttctcagggcggcaaatgtggcaggttcataaggaatgcgcagggcacctgccggctgagcgtggaggttagggaagtccaaatgatgcccttgggctcccctgccaaggtcgacgctctgccaggggatggagcccagaaccaggaggaactttggttgctcctttattcctccttccaagaagtgtttccaggctctggctcaaaccctcctgggcagaaagggacaggagcctagcttggtcttttaggggagaaaagtgtggcttctgctgggacagtgaatgaagagtgggcttggcactgaccctggctctgctgtgtgacctttgggcaaatacctcaccctctctgatcctgtttacatatccatctaaaggagagaaaaaggagggtattatgaggattaagtgccatactgtaaggaaacaggcagagagggaatatgtaatcaatgccagtttctccccactctccattagtttccgaatttcttgcaaactgcaaaggacagatctcttgctatatttgtgccagaacaccgagtccaaagcactgggcctagcagggagtgagcgtccatcagtttgaggatggtcccttcctctgctttgtaccaagagggggatgggtggggtgcagtatggaggtggggcaacgtgagtctattctgggccatgtcgttggctcagcgggcgaccttgactgagtcatttcactctcaggagaggctggagctgagccagtgcaccttctcctgggccctcctgggatcactgctccaacgcagggagggattgggacagtgaagagtcaggcttctccccacaccagcccaaccacatgctgcccacacctccactcccttaggggagaagtgcctccttttggtcaaggtagtaggagaggaactgagcgttcagccttgtttgatatgtgagcaaactggaattggtttctggccaaggttgtggagccaccgagggtcccgggtgagaccagaatcagttctgacgtgcccctctccccagcctttcttccacatttctctcttcatgacgctctcccatctctgtcttcatgttctatcttaattgatcctcatagcacccctgatatgtagatgaggaaagtaagactcagaggggttaagtgacatattcaaggtcacacagctggttaatggtagggtaagaaataaaacacatgccttgtagcaaacaccaaaagtaaaaacatggtcaccctgattccttgtctgcccttgctctctacgcctggtccaggaacgagttctggaggctcttcccccaatacatcctgcatctggatgacgcttccctctgacgccactgccaccccagcccaggccaccacgtgtccacgcctgccatagcctccctgctggtcttgcggctgccaccctcatcatccagctctccaggtgtccagagagatattattaaaatgtaaatcagatccagtcgcttccgggcttgaacccctccaaggtctgccatcgtgcttgacatcaaatcccatgccttactctccttcctctggtggtgcctgctctcccacctcaccctgtttgattctctcctgtgctcatgccactcccaccactctggcccgcttgctttctcccaagcgtgcttgtccagcctatgggcctttgaactcagagcttcctccgcttggatcacccttgctgggatgatcctaagactacaaccttcctgtcctgcagggctgaatttaaataaaaagcaccgagaaataccttccctgacaccaccccattgaaatgtcacctccttcccctattttccctttatatgaatacatctgagccatctgtcaggacactgcttgctagcattaataattttgttggtttttttgctcatcatctgtttccccactagaatataatttttgttgtgactatgatgatgaaacattgtgtacctcctacataccaggatggttctaggtttgcatatacataacttactgagatttgcaacaactttgtgaaaggtactattattatctccatttttactgaggacacttgatatggtttggctgtgtccccacccaaatctcatctttaattgtagctcccataattcccatgtgtcgtgggagggacttggtgggaggtaattgaatcgtgggggtgggtctttcctgtgctgttctcttgataatgagtaagtctcatgagatctgatggctttataagggggtgttttcctgcagaagttttctcttgcctgccgccatgtaagacatctctttgctcttccttcatctttcgccatgattgtgaggcctccccagccctgtggaactgtgagtccattaaaccattttcctttataaattactcagtcacaagtatgtcctttttttttttttttttttgagatggagtcttgctctgtcgcccaggctggagtgcagtggcgcgatctcatctcactgcaagctccgcctcctgggttcacgccgttgtcctgcctcagcctccagagtagctgggactacaggcgcccaccaccatgcccagctaattttttttgtatttttagtagagatggggtttcaccatgttagccaggatggtctcgatctcctgacctcatgatccgcccgcctcggcctcccaaagtgctgggattactggcgtgagccaccatgcccggcctcaagtatgtctttattagcagcatgaaaacggactaatacaacactgaagcccggagaagctaagtcacttgcccaaggccacacagctggctagtggtaaagctgggatttgaactcaggcagtccagcttcagcgtctagactctggaccacaacactaggctgtaaattgcatcaaggcagcagccaggtctcttttgtttcctgctgcatccccagtgcctagtgcaaggcctggcaccaggaaggtgcacagtagatgtttgtggagtgagaggatgtgtgccacggtgagtaagcatagaccctgccctcagagatatcatatcatcgcttatttcattgctcagaagacacagggaaataaaaataagaagtggaaaaaacaagcctgtataattcaaagcataaacatgttatccttgaatgagtgagattgtttgtagtcaagtacagagtagccctcctgcccctgcacacacaagttagtgtcttatactcattaaaaaagccggagcataaacccagtgcttgagctaagtgtgcacgagttcttacggtgtcagcaagacgtgctcaccagagtgtgtctggcggcatcccggagactctgccaggctaagtgcatggagcagggttcagaggtctgcatgctccgtagtactcctgcggcccaccttgcctggacaacagctgggacaggcgtgtcactgacatgtgtgcctgagcccctctgtccagcctggcacagcccctgctggccaatgctgggacatgggccagcagcctgcagagggtgtgtgtggccatggtgggtaatgacacgtggagagacagaggagcgctcggtgtgcaggggagaccatgggagcagggacagtctccgaggcttcggggcaagggactgatttaagtgaaccatgcacagcggggatgacacacacagagggagggggtggccatcccggcacggttcagaggctcagactcatggctgtgctaatcattagtgtcaataccgtgaatgctggcgaatcacagagctaatgttgctaataataaggggtgatatatcctgactcctcagtcctggctgggtgcccggccagcaagacctgcctccccagtaccgctcagctaaatggctgagccactcgtgcatgagctctctcggtggcaggccagcctgacagcttggcccaataggtcttcgtaacatgggcagattgtggaaatcctgggtgtttttctgaggcttccttcggggcaggatcagcctggcttcactgatccatctctagactctggctccataatttttcggctttgtgaccttggggagtcatttcccctcccccattgtttctgcatctgtaaaatgagaatcattcatgtctactataaaaggtagatctggggagcctctgggatgatgtggaactctgagcagaatgccaagcgcaagtttcaccatacgctaattattattataataattacattttcatttattcagtagcaagaatgtaggctttggggccggggagtggtggcttatgcctataatcccagcactttgggaggccgaggcaggaggattgcttgagcctaggagtttgaggccatcctgggtaacagagggaggctctgtctctgcaaaacaaaaaattagccgggtgcagtggctcatatgcctgtaatcccagctactcagaaggctgaggtgggaggattgcttcagcccaggagctcaaggctgcagtgagctatgatcatgccactgcactccagtctgggtgacagagtgaaagagaatttaggttttggaaccaggttgagctggggtggaatcctctgctgccacgtgctctaaggcctgggcctctctggaaaatggggatagcaccttccttacggaggctgggaggattggagacagttcacttgtaacaaggaggatggtgcttggcatggcggggggggtctcaggatacttaaggtagtttataggttttaactgagttcctgccgtgtgcagtcactgtgccctgccctggagatacctgtccccgattctgtgttagctgtaggtgtttgagtcagtgtggtcagagacaggaatgctggcctccttggagatgggcttaaggggctaggcgagaccggtaacttcatacctacttcagggccaggaagtccacatacatttgacccctttctcctccttgaattccagaggggactcaatccatctcagcacctcccagggagctgagagccctgaagtcagtgcagtgtcctccgtcaccaatgccatcaagataccccatcagggactccagcactttcactggggcagttgcccccctcaccaaggtctctctgagtgggatcacaaatgccattacactctggatcattctgctggtggggcaagagtggcccctgagctgatggggcggccctagccccaaatccctgtcatgtccattaccacatcagcctcccagcttagtgccatcgggaaaaaaagcaggggtggtgcctgtcccagttggcaccagagaaaacaaaggctcaggcagggtatgtgacctgagcaaggtctccggatggctgtggctcagccctgatgaatcacagaatacctgagcgtcccagggcctctacccaggctgtatcctctgtgtggagggacctttcatcacttcatttaggtctctgttcaaatcttcccttgtcagagagtccttcatgagccacttgtcacagtcagggtaattaacactagctgctgtaacaaacaattccaacctcttcttgacacagcacagtaaaagtgtattttttgttcatgcaaaatcaaatgcatttattcctggtcagaggctcccctgagcactcacatccaggcaatggttctgggggcccagcctctttcattttgtgcctctgtcatccctgggaggttccccgctggatcctctgtattcagtctgctgaagagtgaagagaaagatcacatggaggctctgacctagagtttcaagggccaggtccagagtggcatataccatcgacatccacattctagtggccagagcaggtcacatggccaaatccaacactgatggggagggacagtgcatgccacatataacaggcgggggagaggagtgaataattcacaccatggtagaggatttcacaggatgtctggggccaggcctgggcgacacttattccctgcttccatggaccacaactgactcacacatcctccttaactgcagggggctgtggggggcgggtcttggaaatacggagaagctcatggatattggtgaaaactgacagtttctgccccacaacctagtaattaaagagatcctagtagtgcttctcatcatgtgggtgaccgtataattcatcttccaaatgggaccattttaaggtgaaaggggtcactaatgattatcctctgaacactgggtttcaagcaggttgctccagggatttggggcacgtggtcaccctactcatcactctgcatcctctcagcctgctttattgttctttttcacacttaatcactgcctaggagtggactccgtgaggacagggacctttctccctctgttgctatatcctcagtgcctagaactgggcctggcacattagaggtgcccattatatgcctggtagatgaacgaatgaattaactcaactgtctcacagattccttttgaggaccgactgcacattcatccacagtgctcctgccctcctggagctaagcagatgtcaaatgagaaagggtgatgtccaaggactccagaaggtcatgcctgagtctggaggtggcttcaaggttttaactgcgttccactgcatgcagtcatcgtgccctgccctggagacacctgtcccaggattctatgttagctacaggtgtgaggtcagagcagatcccttgagaaggtgatatttgagccacagatctttagaaaacacagaccatagactcagttccaaacagtcttgagctcacaatttggtttggccttttgggtgctgtgtaagcctaggtgagtcacttgacctctctgaaccttagctcgctcatctgcaaagtgagaccaggcatccgaacctttgcagggtggttgggacctagtaactggtgttgattatcataatcatgatttctcttatttagattttagacttgaagctccatcactatggagcttggtctctggccatggagggaccatgaagttttgcccttctcatcatgcattgttataaagccaactaaggacagctccccagttcctagtgcccagagccctaaataacaagatgccgcttcttcacgtagggttccatgatctggccttagctctgccagttagtagctgtgtaagtctgaacagcttagcctctctgaacctctgtttccttggaataggaatatccaaggctatcttatagggtacaggtgaggatagaagagataatgcagttaacaagcctcctacagcttctgcccatagctatgatggaaaagcacgagggttgatgttgattgcttgcagtgtgccggccaacaatggtgacagccccaggtttgggggctcagtgttcgagcccccaagggcactcagattctgcccagcagcagccaccacagggtcctgaaaggagaaggtttgctcccagccgctctgctggcttagaacaggcagtgggtggtagggaggccaagagagtgatggaggcattcccgggcgttgcttcagcttcactgtcaaccatggaacagttatagatggttttgtcctcttggagatgtccatcccattagcatccacacacggccctaatgggcttcagaaggccaatgccaacagtcttgtcttcactccgcagaggaggccccagccagatggatggagcggggctcagagctgctcagacatctgcaatgtagccccagggaactcaaaaggccccaggcctagggctggaccctaagcgcagccaaacccagtgacttggctcaataacaggcaggaagaacaaggcacagtcactgctcataaaacagcagcagccacggggtggatgactgactgggaaccaggtgccgaaggtgaattttctcctttcatcctcaccatcctatggacttggtgtgatgatctctacttcgcaaatgaggcaactgagggtcaggagagtgaagtgatcatctgtggtggtccagctagggatggcagaggtggtggggtggggggctggggacacgaagggaccaggacttgagttccgttggtctgagccccagatgcatgctgtccccgattccccacgcagcgtctgcgaatccatccccactgaaccaggactgtccagctgcatctcatttcatcagctgctgtggactggaacccctcatgcagccctgagcccatgtgttcctttaaaaggtggagacactgaagcccggagcagggaagagtcttgcccgcatcacacagtgatttaattgtaggagccgatccgttcctaggtctcaccaccttatctgcatccgtgggatccacagaccactgactggcatcccaggagccacggtgagcccactgtctgtgtgttttagttaattttctcacctttaggtagaacatgcattcctcgcttcaccccagtccccacccttccctatcgccttcacctgggctgatgcgctcatttgcttcgctggcctgatactgtctgcatttgcctctctgcctgggctctccttacaggggacttggatgggatttgatttgagtgcttttctctctttcttttgtcatctctttcaaggccgcgagtcccatctcccattttacatcttttttttcagccctctttcctatatcaaaacttccccattcaaagcttcacctcctcaggtcttcagactcagtaaaggaaaggagatatcagtgggcagccactcagtcttcttggctcacggaggctgggatcacccctgtcacccctgaccctgtgctgggctctgccctgagagaagctcacatgtccccagctgcaatggatctgatgctgagaatgattctcatcccaggcaaggaggcccagggcagggctgggtgaggaggccctgccctgggagagcagtggcttctgggttagaactcacttgaaggatgtggggaggggtgggggtggggtggattccaggcagagaacacaagagctaaactatttaggctcagagaaaatggagttgctttgtgtaaccaaattcgtcctctcctttcccctccctttccctctttccctcccttcctttctcttcctcccttcattttcctttcacttccctttcacttccctagaggaggggttccttggagacccttgcaactggctggaatctggaaaaatcctggaggactgtctggaggaagtgtgaatccagggagggcagactgtgaagtgcaggaggggagcaggggctaggcaaatggggggctcacttatgcctcctgcaggtcccagctgaggctgatatagtcaagaggccagcgctactagattcacacttcctccaggcagccttccaggatttttgtagattctagccagtcacaagggtctccagggagcctctgcttcctgggccccatggcactgtgcatgcacttggattttgtcacttgcctttgtcatttgcacccgcctccccagctgtgaccccttgaaggcaaggctgtcctgttacacctggcacccagcacgggatgggacatagagagagcctcgcccctgcatggaagctgtcccatgagtcctctgagttttggccctggctctgctggtgccatgtgacttccttgctgagcctctgctcctgcatctgtaaaatggggataaggatacctactttgtagggttgctataggaataaccatccagcccttgtgtaccatgagcttggcacctctgaggcagtcaaccaactggcttgagagcagtcagaaaaaggggtcccacccaggctggctctccagccccctccaggggcaattctgctgagctcacgaaggggaagaatgcacagcatgcagggccccgggtgcccaaaaagctggggtgcctaacagagggactcagcccctcaaccaagtcataggacatagagaccatcttggcaagcctgaaatcaagaaagacagccaggcttggggaactggtgatgaactgctggtgcagtgttgaggggagccgggaagggctggaagagggcaagccagcaccccactctgttgaaggccagacaaaggctgggccttccaggaggcctgggcgctgacctggggtgcgccatgctcccatccctgcgggatcaagaacgggaagctaagaagtgtggtcggtcaggaggctgagagcctaattgattaaagttgtacatgttttgatgggcccggatgcggtgctggcgaaaggtgaagtattaatacatataatatataattatgatgtgccaccggcctggcagcctgtgtaaatagttacccagctggtagctaatcccggtaagtgggccagggcacctctcacacgcgacaggctggcttctatcctgcggggagggcctgggcttcacctggacttgtgtagccctagaggaacattctgatagagtgggtgggcatccagggctggggctggcacttccaggggttggagtgtctgggctggcatggaattctccactattaaggaggtggtcatcagggaaggaaggaaaccaggctggaccgggcactcctcactggctaagccctgtgcccactgggcactcctcgctggccaagctccgtgcccacaacctcacacttcatgcccactctgcgtctcctcctcttctctctgcagatggagaaaatcagagaggcttaaggaagcacagcaagtaggcgacagggctgggattcaaatgcagtcccctggctctaagcccgagtgctgtttcttccagaaagcaacaacaaagccactgtccccgtccccagccccaaccaagttcactcttgctgagcccccaaaaggattcccattgatcccctgtactgaggatacggagagaggtctgtggcattctgggtctctcctcttaatttagctcaaatgttgagaaaccagagaaagttaagggaagattccaaacaagttgagctgccactaacagccagctctgaggcttttgtctctgagtgtttacagcccaggaagtctggcatccactgcaggtgaccgggcagggtgcaggtgtgaggctggaagtgagagcggacagtgggactgaaatccggactcagcagttcccgtcaaaaagacattcagactctcccagcactttgaggggcggaggtaggtggatcacctgagttcaggagttccaggccagcttggccaatgtggtgaaacctgtctctactaaaaatgcaaacattagccaggcatggtggtaggcacctgtaatcccagctacttgggaggctgaggcaggagaattgcttgaacccggaaggcggagtttgcagagagccgagattgcaccactgcatgcactccagcctgggtgacagagggagactccacctcaaaaaagaaagaaaaaaaaaagagacattcagactcaaaataactttctacaaccctcactgctgctgtgttgctcagtccagggccccagactccctggtgcctcgtggaatttcagaggggcagtggggcttctagctctttctttggagggctaactctgcctcgctgtctgtcccctggccatggtggctcacctgcctggtgggtaccccaggacctcaccctgtgagccactctgggggcagctccaggagctcaggtttactgctccccgccaatcccctcaaggtctcggtcatagccacaccatggccctgtgcgtgtgtctgtctataagtgagtagttttctcccctgcctccacgctgcagcccacaagctggggactcccaaggcagggggttcattcatctctgtggtcaccatcgtcctgttctcaacgtgtccgctctgactttctgcctcccagcccggtctggtacacacgttaagcaagactgcaacctgcaagtccagcccgtcttcctcccagctgcagccactaatgggatgctaagtgcctattttgcagatgaggaaattgcaattaagagaggttaaataactttcccagggtcacatatttggttcgccactccaacaccatgatgtttccactccatcagattgcctctttgctggatgagtcttggaggggaggggtgtttcctccatctgactcagggctcccatagggtctcctccatcagagtaagcatttgctcagagcaggaactctgtctctcccactagactgcgagcttcctgagggcagaagctgtacacctcccgtcagccagaccctcgaaaggtagaacgtgcatctcctccattacactaggaatatcctagtatagggtccctggggacactatgaaggtcatatctcccccatcaaactgggatctttccctaagggcaagctcagtggcgcccccatcagactgggagctccctgagggcagggactgagtctgaagtccttcaggatctcacacacctgccctgtcattccatcccccgccttaggaccccctgccatggcacccctgatggtgttcacatcctgcacaggactcaccctcagccggagcagaagctgccaacaggccactaaaccacagtgcaccctcggcattaattagtgttgctgctgttaagtgtttcttcccatttatgcaaatcagcgaggtaagaggcatataatgaagtgtttgtggtttaatactgtgcggtaggaacgaagaggaattttaattactgactcctaattggatggacggcttgttaatatcctcctgacaggacatctgagtcacttctgcccacccacccaggcccgggtgtctgctgcccactcctgaccagggcagcgtcggggaacagtgcctccagaagccatccttgctgcccttgcccaggggtcattcctggcatccctctgcccttgactttggagctcctgtgtctttcaatctcttttcttctctctcaatctctctgccttcagaaggccctgggcttgtgttcaaatccccattctgccacttactgtgtgaccctggacaagtcacttcccatctctgagccatgttcttcaggctaagtactggatatgggtgataggcattgagaaatcagggaggttatgtagttagaaggttatgcaccctttcagagaagggtgggaaggtcctgcccaggcatagaatctggaggagaaaagaatgtagggtgtgtgggagagtctggagatgggcgttacccccagaggtaggaggtgctgagggcgattccctcccactcatccttcggggctctgctagggtggcacctcctcccagaccctcccaggttccctggtgcctgtgttgagagtctctgccttgggtttggtcgcctctctgcccatcccctgaccatcacatcgtgctgtcactgtacccattagactatgagttcctccagctgttctgttctattgacccactagcctggtgtccagcacagctccggaacctgagaaaaatgtgctcaatgaaagatgatcagtaggctggacttgtctgctgaagatgctccaagtcagggtgcagtttggattctagagaaagcaggcaatagggagccatggaggactccgaacagggggccgaagaaatgttagaatcaatgggcccttcacagctccctctgccttctctcggattcacctgctgatatagtttggctgtgtccccacccaaatctcatcttgaattgtagctcccataattcccatgtgttgtggaagggactggtggttcccccatactgttctcgtggtagtgagtaagtctcacgagatctgatggttttataaggagaaaactcttttgcttggttcttgttctctctcttgcctgctgccatgtaagatgtgcctcttgccatgattgtgaggcctccccagccgtgtggaactgtaaacccattaaacctctttttctttataaatcacccagtctcgggtatgtctttttttttttttttgagagagagtctcgctctgtcacccaggctggagtgcagtggtgtgatctcggctcactgcaacctccacctcccaggttcaagccattctctgcctcagcctcctgagtagctgggattacaggtgcccagcaccacgcccggctaattttttgaatttttggtagagattggatttcatcacattgggcaggctggtcttgaactcctgaccttgtgatccatccaccttggcctcccaaagtgctgggattacaggcgtgagccaccttgcctggccctgggtatgtctttattagcaacgtgagaacagactagtacagcttcccaatgaacatccaaatcttgacgtggtccaggtcctcagaggacaaattcagaagcatttctggatcccctaggatgggcagagtggtgatctttgggcagggccaggctagggggagagaaggaaggaaaaacagtcacttctcaccgaactagtttaagaagagttataaccagatagaaaagcctcactggtctcactctgctggagttagagcctagctctgggacttaaccagctttggggtccttctgagccttcctatacttatccataaaacgggctaaacctactttatcagatgtgttcagagaatacatgacataaagcacttcaagcgctcacagcattatgccctcatgcagtaggtgttcaacaaaaggcagatgttattatagttagatttcctataatggcaggcggtgagctctcctgggtgtggcttcctggtgacaagcccaggtgtctgacttaaggcacacttggctctgcactttctagctgggcgaacttgtgtgttttctggtttaagtcataatttcttttctggtaacatgaggatcgtacagtacttcctcacagggtctggggaaggaccgggcactcagagcgtgctcattcggtgtgacgatggctgctcctgtcatagtcattataacccactgatggggggaactaaaccagcagcttccccattctgaacttcagcttccttgttctatctgggaatcacagtccctgcacccgcagccacccagaatcactgcagtcagcagatcctattgctgacaagccttcctaaactgtagagtgctggaccaatgtgggctctgacggttaggaccacagagggtatggagggtggtggtggccgttcctggaggctgacttggcctgctcgagatgggaggtgactgtgatccatgtaccccctgcatcctggaagacactgggaagtcattatgggtgcaggggaccaactgtagagctttaggcctctgttcctgctggggcctggccagggaatctcttgggccagagtttggcctccttggcctgcacttgagatcagcaaactcctgaatctcaggggtccaggtaaggaaagaaaaccccgtgactcggccctctcccgttttagcacggccagcctcagcctcctttctccacagagtccctacggggccctcccagcctccactggcatgaacgagaagggaaagccagcattcacacaatgcctgctgtatagagcaggtgcttctctaggcactattaccatccccatgccgcagaggagcaagcagaggtggcttgcggggatggtgctgtgaatgacccttggagataggtcaccagcccaggcctgcctgattccaacatcgtgccctgtattctgagcctgcaaatgccagcttgagtcccagaactctacccaggccaccaaaagccttatttaccttccccccagcccactttcctgggcttatcaggcagaggccgaagcagctgctcacattgcaagcgcccattccaagtatcccaccggtgacaggagaacaaacaagcctgaaccctcagcaatcccctggctgagaggcctgccagagttttcaaaggcgaggaaaactatgaaacggggttaaacaaacacatgtttgaaaggaaaacagatgccagacagatgtgctcccaacttacactgatacagtctcgcgtggcggtgggaggaggccaaatatttatgaagcatttactgcaaaaggcaaagcggtggagcaaaggcacagaggcttgaaatcaagcagatgaagcagacctgggttggaattccagatccccttggagggctgtgtgaccttgggcagggcacttaacgtctctgagcctctgttttctcatctgcaaaaggggatcatcatacccttcctatagagcaaacttcttaatatacaggtggtccctaacttacaatgattcgatttcctgtttttctttctttctttttccttttccttttctttttttgagacagggtgtcactctatcacctaggctggagtgcagtggcatgatcacaactcacaactcactgcagcctcaacttcccaggctagggcgatcctctcacctcaacctcctgagtagctgggactacaggcacgtgccaccacatgtgcctgtatttttgtatttttttgtagagacaaggtcttgccatgtttcccaggctggtctgaagctcctgagctccagcaatctgcctgcctctgcctccccaagtctgggattacaggtgtgagccaccgcacctggcccaatttgccatttttctactttacgttaatggtgtgaaagcaatagccatttggtagaaaccatcctttgaattttgaattttgatgcagtgggaaactccctagcagtgccagacagcattagggagctgcagctcccagtcacccatgccatcaggacagtgatacactgataccctgcagcttactgtggtgcaaagtggttttgcccaatatatgccgttgtaagtgttctgagcacgtttcaggtcagctaggctaagctttgatgctctgtaggttaggtgtactaaatacatttttgacttaggatattttcaacttaagattggttaattgggatgtaactccactgtaagttgaggagcgtctgcatattagggacatagcgtggggcctgacatatgataggtgctcagtaaatgttagtttcattccctttattagagggtttagcaagctgagatatgagaccgtattcaccctctaaaccaggccaaaaggaaggagccgctctcctggggacaatgatggtaagtgaggtccagaaggcagaagggttgaaacccagaggagtctttggacttgggggaccaggatcatgttctgtgaacagtgatggtgtcacattgggggtggtagacggagggtgagttggagttggccatgcaggatttggacatggggaggttaaattaatccccagtcattctagggtgattcttctgaatgaaagatgtttccatggggcttgggggcacagtggcagaggccgggtatcgtattctggggttaagaccttggacaaatctgcttcacttctgtgagcccgtttcctaaactataaagggagaatcatgatatttaccttctggaattgttgggcaaaaaagaaaaaaaaaaggcaatgtggcaggccggtggtgactactcagaatagtggttgttattggtggtggtgttaatgtcgcaggaggaggtatggcagatggggtggtggacagaggatgagttgcagaagggataaaagagaaagaggtgagagggtggagggaggagttagtgcaggatgggaggatggatgtatctgcctctaaatcccaatttccttggcacttgccgggaggcggtttcttttgcaaaccatgacacatttgcacagggttagagcagatccccaaggctctggacaaggctgcacagctacatttcaggtacatcggtctcggtttccccagcaggagacaaggctcctgagataagcctatgctgtccttttcatccactctatttgtgctagagacctgcatttttccaacttccctgcaaccccattggtgcagccagcattggtgggtgggaaaaggccccccaagctcctgcccagcgcctctttggggtgggagaagggaaggaacagaagtgcccaccaatgtcttctctgacttcactgtgtcttcacagcctaggggcactgatggatttagctaagtgctcataacttccaaaccaaaagtcagagctcaggatctaacaataacgggtgttttccaattcctgaaaaatgatttatatgaaaagggaaataccgtgatagccatcatttatatgaaatgcaatttagttactgatttggtgaattactggaccacaatgaacgtgaaaagaagtagagaatccaccaatgggagactgcccagtggctgacacatggaggataatgatgatgacaataatgatagaacagcatactagctccatctgtatagcattctacatggcatgtattatgactgctcccttgtacagatgaggaaactgaggcataggcaaggtaagtaacttactcaagggtttaggactaataagtagcagagttgagatttcagcctgggtttgactgactccagggcacaagtttttcccttccttgctccttccctctcccctttccttctttcttccctccctctcttccttccttctgacccccttctttccttcctttcattcttctccttacctcctttgctgtccttccctttcctgtctttccctccctccatccatctttcctttttatccttttctctcctttctttcaatcggatattgataaattgccctctacagaggttgtacaatttacgctccccccagcaatgttggagagcctcaccctgttctcccacaggcttgccaaacacggtgtcagcaaacacacaccttaggaaatgttgcccgtctgatcagtgcaattttaactgatcgtgaaggaggttgagcatcttttcatatattgatgggcaatttgtatttctttcttcgcgattatctttcatactttttgcccatatttgttcctttgttggtattttttcttttatatatatatatatttattatactttaagttctagggtacatgtgcacaatgtgcaggtttgttacatatgtatacatgtaccatgttggtttgctgcacccattaactcgtcatttacattaggtatatttcctaatgctatccctcccccctccccccaccccacaacaggccctagtgtgtgatgttccccttcctgtgtccaagtgttctcattgttcaattcccacctgtgagtgagaacatgcggtgtttggttttttgtccttgcaatagtttgctgagaatgatggtttccagctgcatccatgtccctacgaaggatatgaactcatcattttttgtggctgcgtggtatttcatggtgtatatgtgccacattttcttcacaatttctaggaacttttcatatgttgaggataacattcataataggagtctgtatttcttggctagggctgccatagcaaaataccacaaactgggtggtttaaacaacagaaatggtttttcccacagttctggatgctggaagtccaagatcaaggtgctggcagcgttggtttcttgtgtggcctctctcctggacttgcggatggtcacctttttgcggagtcctcacatggtctttcctctgtgcatggcaatttctggtgtctcttgtgcctccaaattatttcttcttataaggacactagtcagagcagattagggtccaccctaacagcctcattttaggccaattacttctctaaaggccctacatccaaacacagtcacattctgaggtcccggggattagggcttcaaataagaattttgagggaacacttctcagcctgtaaagagtaaagtagaggttcttcttcaaagactttcctccccatctaattaagaataaatagtaacttctcttagaggcaaaatttgttcaaagacctgtgctaacatccttaaatatctgctagccgtaataaagaaatcaattgcactttatgttcttagctcccacaatttagcctaaatatttgccctggcatgtttataccagtccaagcaagcattaagtcatagcctgttcctcttccttatttaaaagtgtttttatctttctcagcattccacaagttacttcctccttcctttgttctcttctgcttttgcctcttttaaaaagttctaagttgctagccaatcaggacaaatacaaaatgtgaggtcccattccagccagtagaaaccagacacagcagtaaggtagatgtgtcaggttataaacgaccctgtctcctttgttcagtgtactctcgtggtaaaactgctagcaagtgtaccctttctgcagaaagtaaaaatggccttgctgaagaaattaaatttatgttcaagtgctatttctttacagaaccagggaacaagcattcctaacaagccactaacagagtcccacatatctttttttctgagcttgcttttaaaaaaaattttaccttgtatattttctccctaccctatgcagtatagcctcctcaagtctccaaatttgaatatctgaaatcagctttgctccagaaaactgagtgtttatctttgcctggtttcccctaatttgtcttcagagacagcttgatccagaggaaagggtgtgatgggctttggagtcactttgacctccctggcctgaagtcctggcaattcgcacagccgcagggtgaccttgggcaagtcactctatctgagacgctgagtctcttttctataaacgacgctaataatagctagctggcagagctgctgtgaggacgaaatgagatgatatctctagaacgcgtagctccgtgtctggcccgtcaccagggttcagtatgctgcaaccattgcgattttctttatgaataacagctcgtatttatcaagcatccatggcaccgagggcctgaggggaagggggatgcagagtggggtctgtccaggcatctgctctcagggactcatggtcaggaccatgacctggaatgcatgggccaggccctgctgtccttcaaagcccaaatggggaagggagactcatatctgagccttgtaagtggaagaggattttcacaggtaggaaggaggggtgtgggagagggcattgcagtgggaaggcccaggatgtcccagagcagggaggcaggaaaggagagatcaccttcattggatcacaaggcatctctgtctactcgagagtttctggtttgaaagtgggaggcagcgtggagactctgttgtggaaacaggaaccgtctttacctgaaacaggcagaacacacaagtgtttgatggagtttgactgtgaggccacaagtgcttgcagagggaaggggcacggggtgagcagatgatgttcacgctacacatcgctggctgagcctgagctttcagggagcaagggctctgctggcacggatcgcagagggcttgagaagggtgtatctgaagcaagagtgctggatgatcagagacatccccaagaagtggggattggtccaagggcccatgctggatagaggtggctcagtgcctggccctttacctcatctaatgctaactgcaaacctgcaaggtagatatgaccggccttattgtacagaggaggaaaccaagacttgaaaaggtgaaattgtttacccaaagtccaactaggaactaggtggaggagctgagcttagaacctggggagcctaaattctctgcatgcacccccatgctggttagaaaagggtcttgggtggtggtgaccccagtgaaagtgatccctgtggaaaggcttagtgccctccaccacccacctgccttgccaagttccctcctttcccaccgtgagtggattaggctgagaaggcgtggggtttatggtgagcccactctagagaaaagggccccgtccaccctttccttctgctgctggaacctcattgcatacctccaccctcgtgatctgctggggtgggggagcctatttgggacctcacctccatccccactcctgctgtacaggggagagaagggtccccactgaacactctctgttccccacagcaagtgcagttgtgtggccagggcactctcaggttcccggcgccctgggtgccactccgaagtgtctggctcctctccacagatcccagggccagctcctcctgcacgttcctcattcttctccctgctccacgtgcgccacaaacaccttgatcacctctaccgcaggaacacctgctctccttttaatgaccacattcatggaaggagaacaaccagcttagcatcatggtccaaaatgtcccccaggggctggacaggaccttgggagtccagcaggaccaccctgctgcctttggggtgggggtggggtgaagacacgttaaaccctctgaactgcaaggagggtctctgttgctgccagagccccctcctcgtcactctgctcaccaaggaagagcatctggccgttaacttatatataataacccttaaacgctgccattaagtcacctctcattcttttaaactacccaggaagggagttcagggtgatatacggaggcttttatggctggtactgggcagcttaaggacttagcagcacactgaacacacacattgttgcataaataagaaccactgtaatatcaaagcatcactcagctccatgcctgagtttctcagcagcacagaaccaacatcctgcaccctgggtcatcgtcacttagacaaggggacctgaggacagggtcattgcctcagagctggaccactgaatcccatgatgttaccactgctagatgcaccaggagaccctgtcactttatcgcctgtccctctctccttctttcactcagccttctccttaattacgccttatgttgcaaggggcaggggatggaagaagaaaggaatcgctccctatccgaattaacctgctgcatgccaggcactttacacatattatctcatgaaatgctcgattgtacacagtagtaaaggtgttattgctcatttatagctggagagactcagtaacttgtccaaggtcacccagcttgtaagtgacaaagctgggatttgaaccctgcctatggcccttgcatatatgtcatttgcagtaaacacggggttctggggccggaggggagcaggtgctggtgcaggtggacagccccgaggggccccgaagagccctgtgtgtggaggctttgaaatcaggagtagggggctcagagtgtctgtctgggtttgcagacaagggcacagcactaacctgtggctgctcgcctgcgtggctatgctcacctaggagcacccacttggcaaatggacagtgttaatatttaatgagtgatgatgactttgggggaattgctgtttactccctcagagaaaggctcagaattcacattgggccccaatggcccaggcagagactccccagatcagatccccaccagctggatccgccatggaggcccatctgcgaagtagctttggcgagcgggatccagtgtcaggtcctgagggtggaggaagagcagggaactgggaagtggggcccctgtgcttggggaattccactcatgcctgggagtggttgaagacgaagcccaggcgtatttctttcttccaccattcctctaacccccgtcttgcccacgctaactgggatgccaaccgtggtgctggggtcctctgctctttccaattcacaagggtggcccaagcattccagggctaattccacttcctcataagaccccaaggaaatcacataccctggctgcttccgccccatgtgaggatggcggcacaggtggccgagttagcgagtgtctttgctgatggctgaagccccctgcccccagcccagggtagggagttctcactggcagtcagatgcgcctgattaacagaaatgaaagatgggctaattgctgctgaatatgagccgcttgtttggtagggagagcagggttttcaaatcatggagtcctgggggtgcggggaaggactgtccttggggctcctggtccacagtgtggtacttggcccacagagatgagctgcctgttgatgggggaggcagacaggctggaaaatgcgtggaccataagacaggagtggagcagggttttttggcgggggaggggatctcttactctgcaggagatggaaccgggagaagttcaacagagcagcggtgccaacaaggtatggcaggtggccatgaaggccacagatcttaggaccaagtgcatctgtgttcaagcccaggatctgtcacaagccccagcccacagcaggcgcccaggaagtggtagctgtgagtgccctcattgtggagaaggtaaggagggcattccagttatagggagccacatgggcaaaggcatcactggaccttgatgctgcatttgggggatcctgtgccaggattaaaggatgccagtggcaggggcaggggaggaagtgaggtcagaaagagagattcttgggaaccagacagctagctaaggaatggggtcttatgaagccagtgaccatttctgagtagggattctagaatccagatttgtataagacaaatcggtggctcccaaatggccaactttgaacccctgctggctggctataggccccaaagacctcatttggataatacattaatatacagagtgccaggtcccacttccagagagtctgattcaataggtaagaatgcctaatatgtattaaatgtcttctgcttgctgattttatcctatatattttacttttttgtttaactaatgtaatcctcacaagaatcctatgggaataggtactgttattgtccccatcttacagatggaggaagtaaagcacagagaggttaagcaacttgctcaagttggcacagcagcaattgtcagagctgggatttgaacgtacactgcctgactctggagtccatgctttaaagcacactgctatcccggttctgatgaaggctgaggaaatctcacttggctgggcacacgccctcctgtccatgattcttccaggctgcagatttgagactcatgatcattgtcaaccagtggtcttacattcagagaagacagtggtcagggtaggttgcaccttcaggaagggcttcatggagcaggtggacttaagagggtcaggttatggtggatgcagggaatcagagaggaggacaatctgggtgagaggcatagcatgaacaaaagcaaggaaacagcagacatgcaggcccgtcggggaggctgcctgtggaaggacctgggagtgagactaggtgtgtggaatgagcttggaagacactgtctggagcaagtgtctcggtgtcttgtagcatgctggcctcactctcatgccagtaattgtaagccctcaagatgccttcatttccagagccaccctaggctcagtgagaattgagccatgattaaaaggtcagtccagagaggaggcattcacagattcacaatcctcccaaatgaagactcatccttagggcctgatgggatccctggggtcagagggctggggtcagagggctgcagggcagaacgaaggccagggcacccatagcaacctggaggggaaatcgctcccctctctgctctggaacaggaagtgcctgaaggtccacgattcctggcaagggctaagtaataataggtaaggaaatagtcatgctgaggaaggggtgtagcagagcagctaggaactcagtccccagcgtcagaaagttttcgttctggctctgctgctcactagccacgagtgacttttcctctccaagcctcagtttcctctgctgtaaatcaagaattaatcatgctagagttgtcatgcagaaccattgagataatgcacaatgcttatcacaagcacttaataaacaaaagccttcattcttatttctggcacaaactcccttggccacctacttagcaaccattctcttctagcaaaactttaattttgttgagtaattccccttcccccatgtggatatggacttcacgggggtggcaccaactccagagccaagaagtgagtgatgattggtctaaggctaagccaatcctggttgacctgttccctctaatagtgattggttcaaccatgggcagctgatacagttctgttcaattagtggaaatctataaaggagcttctgggaaaggttgaagaggtacctgggaagaaatagttccttttcttgtcccctggacaggattgtgtctgcagttgagggctggaaccacagcagccaccttgcagccatgcttacaggctgaggagggcaggaaagaaagatagacttgggactttgatgagggcctgggctgattaattcatcagccctagaatccccctagctcaagacttcttatgtgagagaataattttcaacattgtttaaaccaaattgagtttcctgttgatgtttcctgttacctgagatggaagcatctacctaatactctattaattaaagtttggtaagagtctgttttcctggagcaaggcacttatgtacatattacttcttgttacgctcacactagtagagcagaattaatatccctatttgtcttagtctgctgtggctgccataacacatatcatagactgtgtggcttaaacaacagaatttgatttcctcacagttctggaggctggaagtctgagatcaggctgccagcagggtcgggttctggggagggctctcctcctgacttgtagatggccgccttctcactgggacttcacatggcctttccttgttgcatgtgcagagagagagagagaatgaatcttatcctcttcttacaaatcctccaatcctatcagattagtaccccacccttaggacctcatttaaccttaattactttctaaaacccctacctgcaaatgcagtcacattgggggttagggcttcaacatatgaacttgggaagacacaattcagtccatatcacaactgcacacccaagaaaaattaaactcacagatgtgaagtgacttgcccaaatcacatcacttgcaaggggcagagctaggctttgaacagaagtctgcactttaaagtgtgtgctctctgtgctagtcaagcatcccctctggtgtgtgtgtgtgactcaatccataagtcatcttactatcctactctgggaaagataattaatataaaatttttcacattttaaaaaaacagctttaggccaggtgcggtggctcacgcctgtaatcctagcactttgggaggccgaagcaggtgggtcactaggtcaggagatcaagaccattctggctaacatggtgaaaccccatctctactaaaaatacaaaaaattagccaggcgtggtggcgggtgcctgtagtctcagctacttgggaggctgaggcaggagaatggcgtgaacccgggaggcggagcttgcagtgagctgagatcacaccactgcactccagcctcagcgacaggcaagactccgtctcaaaaacacaaaacaacaacgacaaaaaatcagctttaattgaggtataatttaccaacaaaaaagtccaattagaactgtcagattagctgcattttgacaaatgtatgcagttgtgtaaacaccaccacagtcaggatatagaataagccagtcactcccaaaagtcccatcacggaccttttggaatctcctgcatcctgcccttaggcccaggcaaccacccacctgcttcctgtccctgcagtttggtcttttctagaatttcctaccagtggaagcatacagtttgtgtcttttgggtctggctttgttcacttggcatgatgctttggagatttagccatgtggttacacggaccactcgttcatccctttttattgctgtgtagtattctgttatgaggaaatagcagatgtggatttgagttttattttgttttgttttattttatgtatttatgtacgtatgtatttatttatttggagacggagtctcactctatcgcccaggctggggtgcagtggtgcaatctcagctcattgcaacctcggtctcccaggttcaagcgattctcctgcctcagccacctgagtagctgggactacaggcgagtgccaccacgcccagctaatttttgtatttttagtagagaaagagtttcaccacgttggccaggctggtcttgaactcctgacctcgggtgatttgccctcctcggcctcccaaagtgctgggatcacaggcatgagccaccgcgcctggcctctttgaattttaaaatcatactttccatacatgaatgttccgggaagctcaacctcatgtgttctgtggcttgcggggaatcacaccgcaaagacagaaacacccagatggctgggcctgctgagcctgtactgctttccaacagccatcctgggatctttcatctaaatagctctagttccctcatatctccagagagcttgcaccccacccccgaggcgttgcaggaaggaattccatgtgttccccgaatccgagcagcccgtgtctaagcgtcttcacagatgggcagttcttcttttatctagtctcaagctttcatgcttcattactattcttcccgctgctgatgaaatgaagctttgaagtgagggaactgcatggatctgaaggctcgaggaagaggatgacgggaaggcccaggagtctctcccatgtccctggttagacaaaaagctgcctgctccaggagctgatgttgtcacgacccacccacatcccctcgctcgctcttgtcacttcaagcgtgccacccgacttccccctgccagctctctgatttctttgcttagggttctctttgcctggcagggcagttttgcccacccgattcccatcgccttctccccccagggaaggataactctgaggctcacgtctgttcgacactggctcccagcgtttccccagggcttgagccccgttgcccactggggtagctgccgacgacacactctgcctggcttctcctgtgccctgacagtggttcttgacatagtctgcaaataactacctgcaccagaatccttgcctcaggtctgcttctgggaagcccattctgagccaaatggtagcagtgagcactggaggtctctggggccctgggctggctgctttatgcactgctttcatcagtacagtcccctgaggtgggaccgttcactgccatcttgcagatgatgggtaacttgcctgaagtcgagcacttagtgggtggccaagccaggtttcagactcccagcctctcccctacccacctccaccctgaaacaaacatattcaaatgcccgtgtgacccttatctggagtttgagtaaaactcttgggcttgggcgtccaaaactcagaattctgtctctgcctctgtcacagatgtgctgtgtggccttggacaagtcacttcccctatctgggctctatttcccctttataatctggagggactggattgtgtgatgtaaacaggcccctctagctctgacatttggtagaagctaaggttgaaggaggtgattttaggacaaatactaggcctccctatcttatctagcggggagtgaactgcagagttagcacccgcagacagccgggaggaaacgagaaagagccatttgaaggattcagaggaagatgccatggaataacaagggcagctccttgagggatgctgcggggagaggggtgcagacatccaaggttaaaggcaggaggggtcagtctggaacctccttgtcccttgctcctggtgggaagtgacccgggaagaacctggggtagcgggggctcccttcctctgtccagtcccttataaggggtcccttgggcagaggctgttctgaaccttccttcccacgaggactctctcaccaggaggtcacctcccctagcacaggggtggcaggacagggtggagggagagctaatgagccagagccatgttccctccgcctccaaaagcccagagcaaggcagagggaagagccgggtgaattatgcatgtgcctgttaatcacgcactgattaaaataattgtactaatattaattcttccagccctcttggaggagagggcagtgcctgttccctgctcctggcagtagatcatgcccagcagacctgtggatttgtaggatgctggctctctgccagtccctgggcatgccgctggatgtgagctcattgtaccctctgccttgtgaaggagggaaggcccggtgcctggcctggatgtctgaaactgcagaatgaggttcagagatgtcaagggccttaattacagacacacagcaatgagcctggttgggaatcaggcttcctgctccgcgggctgtcggctctgcctgcagggtgaaaacaagaaggattttcaaggcagtgtcacatggttgagctgcttttaggcagataactgcaggaggggacacagagaggcatcctagcttaaagatatctgacttgcaaatgacgagacacctggcttcatttttcagacacctgaaggcattgtggcaaagttaaggaacgatcacaggctctggggccaaacagacttgaattccagtctggtctcccccaggctctagccaagtgatcttgagagcaagacttttcctccttgaaccttaggggtcccatctgcaaaaggagtcagtcaagcccagaactgttgtcgagattaaaggatacaatctaataagtagggcatctcttggcacatagcagataatcctcgggagcagttttccaaggagtaagccttttcacactgatgtgccgttttcactaactggtatttaagagtatctgcgcccctgaccctgtgaccttcttcccaccatggaagactttcctcctcttccttggtgaggtgggaggagttccggggtctccacagagaatttagaatacagagcaattccccaaggaaacaatgttacaagtcattggtaaccacaaatgtaaataaaacgttgtcagctcccttggggattagggggctttgggggctaccctggggctttaaggacaacaggccagctgtgactttagcagtgctattagtagccttgcccactgcttattgagctcctatttgctgggcacttgacatacagcgcttcctataatttttctggatgtatttgaggttggtgagtatttttatttccccctttaacagatgaggacacagagtggtttaattccaggctaaagtttgccatcctcccagtctgtgcttttaaccatgactttattgtatccactgacactgtttatctgggaagatatattgcttgatccaagaagctgacttagaagtgaactttacagacagatccttccataagctaaagattgcatagactctggtggcctagagaatccagagtcagtaataatccaataatgggcactttctgaaggactcagacaacagggcaggtggtccagggtccaaggtttttcctttgccccgaaaagtccatgcagagccctgagcatgtacccagagatggctgagaaggactgtggtcgtgtgtggggatggggtcagtgaggtgtgtgtgtgtgtgtgtgtgtgtgtgtgtgtgtgtgtgtgtgtacatggttcttggtacatatgcataaacctatctatattcatgtgcacataaaacataaacacaggccattatccagtctcaggttctctctgatgatttttttttctgcagttgattattgccttgtcctgtctcttcatctcttatttcttattcacaaacacacttactgatgtggtgtgcatttccttaatttgcatgggtttgcatagtgcctggggaatgatcaaatgtctcatcccctctctccacttgaacaaggaattccccatttagagcaacgaccctgtggaagggggagtgggtgtgtttgggtgattggatcgaggaggtggcacatatatgttaaaaagtcatattcggtatgcccgttgtcttcaaaatatatcctatggcaaacaagcttctcagtgagtggagaagatgatgaatttggatctcctagggggtggatgaagaggcgctgagattggtgagtttatctgaaggggcaggggtgggatgcaaaggtgggcacgatggggcgagtttcttactttttttctagctctcattggccagtgcttaagccatcacatagatttcaatcagctgtaacagatataaccttgaagtgtgaggttgtcaggaaaaagaagaaaggaaggcggggaagtggggagagagagagagaaagagggagcaggctggaaaagagagaaagggagtgtcagacactgtgacaacagcgtcattccctccatcgtgtcctgttgacctgccgcaggccagccccaaaatgcatacagccaggtcttgcccaatcagatattctcgttatccccttaattattctttacaattaagctgtatgttctccatttacagaagaggaagtgaaaccataaagaggtcccttggccaccgaaagggagactcgggtttcagccgaatgtctttcttcctgagttgaaatccctgatccacctcttaccataataaccatgtgatattgaacgagttatctaacttcatgttgcctcagtttctgcatctgtgaagtggggataatactgcagaactattagggttgtataagccttaaatgagttaatgtacataaaatgcatagaacagtgccaggtgcatattaaatcctgtataagtgttagctattattctattgttattattctacgagcatagattgttcagttaaaaatcttgtccctccctctttctcccagtgccccttcctgccagcttctccttccttttaagagttaagccctggggtcggcttctccggccagcaagtgatgtcatccccccttccccttccccctaccccaccccagggtctggcctcccagaggacgggtctgtgcctgttttccagacccccaggcaggcagcagttcggggagcgagcgcagggatgcttattctccgcccttcctctctttgagaatctaagggcataagttagataaccgtgacacctgttttaaattagccttcagaagcctccgacagctgagaaattatttaacagggaaagaattgagttcatgaataaatattaatattaaatcaccacttccctagatttaagaggaagggtgggggactcaccaatagatggaggcagcaggtgtcctggagatgccactgtgcagggctcagagaagccagctgtggggtgggactacggagccaccgaccattggtcacctcgttcctgtccaagccgagaggggactctgtccatcagggaggctggcaggtggcagaggcaacatccaagcagctcacggcaactcaacaggtgctcgtttgagctccaaccttcccaggctgcggtcttagagggagagagactccacctgagagctgcccaaagcatggagcagactcccacccccatccctcagagaggggccactgtcccagcccagcctggccccattgtgactttcatgggtccagcactgttacctccgtgggcccctgcctccatgtaaaaatggtaaaatgtttattttatgaccacattggaataaagatgtattccaaagatgtaatccaggctggatttgtaattctatattcattattattttattcatttttttccctgattttaaaaggaatcaaaatgaaaacatattttgggccctgggcacggtccctactgggcctgatggaggcggcaactctctggctggggtcggggtgacggatgcttgagccagggaagcaggaactggtgaggaggggtcggcttgggggtgagggtctccaggggatggcagagccacccaagggatgtgaggatctggaaactcagatcccatcctttaggtccagatcacagattgaaattaagtaagaatcatcaatttctatgaataacaaaagtaataataatgagtatgaatgaatagcacactctgctttgactgtcctgacccccttggcattcttcaaaagcctccaagcaaaaggaaaagaaactgccaagcacattccaggctcagggccttcgccttagctctcctggcctggcatcctctttcctggtatttgagtgactcgctctcccttcttcttgggtcaccatcctagtgaggttcttcctggcttttggatcgaaatagcccctctactccctttatccactgttcttttcccctccttaattttctccatagcacttcctgcttccttatattccactgcgtgacacatggaaacatagggtataatagaatatacgctgcatgtggcgaggtgtagatgtttaccaggttgtagggactttgtttcattcttctttgtgcacttagcatctagaatagtgcctgccatgcagggtgctcaaaaaaccctgaatgaatgaatgaatgaaacatgtctggcacatacatggcagttacaaccatctttgtgcctagcgctttgggttgctgagccctcagccttcagtgaggaggtattggccttcttccaccattgcagagactgaggcctggacatacaaacaagcatgccccacagtcatacagttaaggtagatcaatagcttccctggataaaacaaagtgtagacaggtccaaggtttgagcaaaaaagtggtttggaaggcgcagttatggaaggatgagggaataagggggctgatgatttcccttcctactccaggttcagcatttcagtttctgtctgcaccagagccttctaggctctttgttggaaactgtggatgtcacactatagctcatacttacttatacagaatttaatatgcacctggcactgttctatgcattttacatatattaactcatttaaggcttatacaaccttgatgagttctgcagtattatccccacttcacagatgcagaaactgaggcaacatgaagttagataactcgtttgatatcacatggtattgtggtaagaggcggatcagggatttgaaatcaagaagaaagacattggagttggggacactggtttaagtgcctgccctgcagaacctaagcagatctgttttcccctgggcctcagtctccccctctgtaaaggagggaactgggccacagtctgtgatccctgcatcgggcagggctgagtgctcccttcttctgcatccaggcttcccaccagggaagggaatgagccctcctccttgctgcctcccctcctcctagtccccggctcagggcctgatgcctgcaggtggtggtggatcctcggtcgtgcggcggatgtgttctggcatcatttaacacctgcctcatatctccgaagccccatcctacacgtagctgtgagcacatagctctgccgaactccaaatagacataagccactgccctgctcggcttcttgtctaattatggctgcgacattgatgtgacagggtgcgtttaattacaggaccatgcacactgacccaaacgctgttttggcccagaattttccagcttgagcagcccaaacgctgtgtgtgatgataataataaggacctttagattgtgctggggattaaatgagataatacatgcttctggcagggagcagggcaccagccagtgacctgtggtcaggtcccagctcctccttccccttcctgctcctgacatggatgcccactctgcctagccatgccctggaaagacacccatcctatcttggctaggcagaatgtcagctctgtcttttttgaatttgtcctccaaggatttgcagaagatgggaacaggggaggccttctgaatatagtgactcttctcccagctcccagaagcacatctggcttggcagcatctttgggccacccaaagccagggtcccttggcccaggcagcatttgggtcagtgtgagggccttcagtaagcacacgttcccatcttgacaccactgccatcactagataagacactgagagggacggcgggctgtgttcattttgtgtctgatgagctctgctataaaatgaggaaagcagttcagagaaattaagcaacttgcccagagttgtccagctaggaatttccagagctgtactcagattcagaactctgggtgactgccctatgccaggcacccccatttgttagcctttaaatgggatctgaaacctttatttatcgggacaagtcctgagtgtccagcagaccaagctttccttcctttccttccaccacaaagtggaaagtcttgccaccacttctgaaaggtgtcttttttttttttttttttttttagacaaggtctcactctgttgcacaggctggagtgcagtggcgtgatctcggctcactacaacctccacttcctaggttcaagtgatgcttccacctcagcctccccagtagctgggattacaggtgcatgccaccacatccggctaatttttttgtatttttagtagagacagggttttgccatgttggtcagactggtcttgaactcctaacctcaggtgatccgctcacctcggcctcccaaagtgctaggattacaggcattagccactgcacccgacccccagaaagtgtcttttgagggtaacttgtttcttcttttcctgaacctgtggcatatgtcacaactcttagcagctgtcccagcactggttcttttccctcctggcagtgaccagagctgtcattaagtgactcattgtgagagcagagactgtctctgtcaccactgttgaatgaatgaatgcatgcatggatgaatgaatgaatgaaacatgaaactctttcctgagttctgtcctttcattgctctagcatgctgccctctgagcacttcccacccctcgaggggggtcatccgtataggggtgggaacagagccaaggtgcctaatggggtccgaagcctctccacctggtgaaattgcctgtagattccatgtctgtgtctgtccacttgacccatgctccaggccccgctgccctcatctctcgttcccctgatgaatcacacgaggcctggtgacacagcatcatcactctccttatccagcagacgcgacatcaccctccttcacccgctgcaaactggctgcccaggcattacaggaagccaccctgccccctcctgggcctggctgccctcgcctctgtaatatcctttttctaatagagtgacctgaaccctatgtgctgttctaaaagcagcctcagaagcccctgagacaggcagccaggtaattcccctggcggaggcacgatcttaccttgccctgcatgtctgaacctgctggctggctgaagaatgtccgttttatagaatataataaaataaaacaggttcattccacaaattttgaggcaccatctagctctgaggtttgggggctcttcctttccattaagttgtaaactgcatgagaactggaccatgtctgtgaatgggtgaattttattttatgtaaattaaacctcaaggtagctggtaacaatgaatgcaagtagataggatatatggcagctgaaataatattccaggaacaatgataaccttgtgcatctggtacccatgaggaggaggtcagaggtgagcctggaaagctggcacaagcccaggtcatggatagccttgagcagcatttgacatcatgagatacgtaacagccatcgctgtgtaacagccagcccaaaactcagtggcttaaatataaccatttattctcctaccacagatttatggtgggtggaggtcagcttgcgtgagttgggctcagctgggccatttaagctgctggtccagctgggcttggctccagatggtgggttgaactgtgtagttcattctgaggtcccagctgagggagcagcagctccctcgggtggcgggtggtgcggggggaagctcttcttgtgaagggggcagaaatgcagaagggagggtcccactgggcaagcctattccaagccattgctcaaccgaacatcccattggctaaagcaagtaacatgacaaaaccccacagtgatgggatgaagaagtaggttctgcccacagagaaggggagaagggagtgggtatttgccgaacaccagttcaagcattcacaaggtaacacaggatagtgtcaagagaataggttctggagtctgggttcacattttgatattcatcagccatgtgacttcaggaaagtaacttcccctctctgtgcctcaatttccccaccaaaaaagcagatatcaaacatagcccattcaatgacataatctccatccagccttctagccttgggcttctcacagagtgagcacttatgtccaccatgatttcaaagatgatgagagatattccaatttcctctttgttatcctttctggttccccgcatcctcctttctttctgctgggccaaaccaccctcccttctccccctccccagggcctccactctcttcaaatatttggaaacgtccctggggtccccagtctcggtcctggttaagccaagctacacagatttcgttcctttaatctttcctcgtaaattaatccctctgaacctttaatcattttcctcgaatgagattcaaatgagacgcttgtctggactcccaccgcacacgggctgcagcctggtgacagcctgtcatgctgacaggtttcttgccctttggggagggtgcaccaagctgccccagagataagaagattgtgggtatcaggaactcataccaacaaaacaacccaagcttttgtgggtatcctgcctctttacctgtgtgtttcctgaagtaggaatgggtggttgatgacgtgcaccctccctcccccagctcctcttgtgacccactggccaccagttatcccttatatggaatgtgtgccctgtctttgtacttggcatgtcaaatcctcacgatctccctgagaggtgagatgagacaatagtaagaccgtgagttcaaatcccagtccagacacttctgagctgtgtgaccttgggcatgtgtaacttaactgttttctcacctggaaaatgggttcataagagtacctgtatcatagagttgttggaagaatacaagggacagcttcaagtagtatttggcacaatagtatttggtcttgatgaatgttggttgttgtaagtcataattactcatgcatggcagatggagagagtcattcagagaggtgaggtgagctgcccaagttatagagatgggattagaacccctctcttaatgtaggtccaacactctggctcagcctggcagaaagggtgcaagggatccccgcatagtgggacaatgagtgggatccacagacctatctagggactaatggaatgtcagatacacgaacagcttgtccttctcttagtctctgggttgtgggtttggaagctggctgcttgtttctattaccttctaggaaatatccttctgactgatcttcaagtggtttccaagtattaaagttaatggttgaggagaaacactggaacaaaacatattccctcccagagttccgccaggcagcaggatccacatgaatttgtaattcctaatggcatcactcaggcattgctcgggcatttaagctgcaggttgtgcagcctatagacagctggggtattgttacactgggcagatctgagttgaatttcttcttcctaattgtgagagcctggtgttaaagatagattttggagtgagacttcctggctcagaatcccagctctgcctcttactctctgaccttaggcaagcaactttacctctccgtgcctcagtttccccatcttggaaaaacagggatgataataatagcacctatgtcatagggttgctgtaaggatgaataaatcaaaatgttgaaagtgcctctgagagtacccagcacaggagagctggtcatgtgtttgttgctactgttgttgccatttcactgtatccctgcagctgggcaagtcattgcccctctctgagcctcagtttctataaaataggtgcactggtccttgtctcccaggagctgggtgagaatctggtgaaataaagtggtggaaagtgcctagccaaatgccaaagcgttatgcattttgagggattattagggggatggcaacataagtgtgagtggcagtgaggtgagtgatgagctgggctatttaaatgagaactttgaagctccccagaagcctgtattccctgtcccccagacacttgctgtgttggaatatctcgtagttttccactttccacctgggagactgatttgctcaaaattggcttggggagggcaaagctcttagggggttgagcacaaagggacagggaaattgtaaatcttgcccccaacagtgagttgctggatgattgggaaatggattgttgaatctcaatctctctgtctcctgctcttcctccctcctctaaagcaattgaagaagaagatggataccatctgtctcaaagccgggcacctggaaatcactcctcatacctccttcttcaccctccgtggctagtcagtcaccaaggcctagaaagatccctccagaatagcacttggagtgacccaatctgtttccctggctggagagcccagtggctctcccctgaatgtctacaatgacatctaactgcatctcttacctcctttcttgtccttttagaatccactctccaagtagcagcttgcagagtatttaaaaaacactcatctgatcgtcccccaattctttgttggcttcccttttttaagaaaaatgttcaaaatcctataaagaaggacctgtttttaccttattttgcagagggggttcagtccaacttcagtggctttgcatatgcctttcctgccccctggaattctcttccctcctctcatgatctccctgccctcacctaacttccctggggtaacttctgctcattcttcaggttcccgttgccttgctcactgatggaggccttcctggctgtgtctgggatctatgctctcatagcatcctctgtctttcttcaacacacttatttttgtaaccatcatccctcctgtgaccatcgttttaacctctcctgggggagtggtaccataaaggcaagctcgggctgctataacaaaatactgtaaactgcgtggcttcaactatagattatttttttttttctcacagttctggggactaggaagtccaagatcagatggcggaagatttggttcttggggagggctctcttcttggcttgcagatggctgcctacacactgtttctgaatatggcagagagagagatacagagagagagagagagagagagaaagagcgagtgagcacactctgatctctctctcttcctcttgtcacaaagacactaatcccatcataagggcctgtattagtccgttttcactctgctgataaagacatactcaagactgggtaatttataaagtaaaagaggtataatagatttgtagttctacgtggctggggaggcctcataatcatggtggaaggtgaaaggtacttcttacatggcgacagcagcaaagaatcagagagccaagcaaaaggagtttccccttataaaaccgtcaaatttcacgagacttaatcactacaatgagaacagtatgggggaaaccactcctgcgatccaattatctcccactgggaccctcccacaacacataggaattatgggagctacaattcaagatgagatttaggtggggacacagccaaaccatatcaggcaccaccctcaagacccatctaaacctaattacctcccagaaatcctacctccaaatactgtcacattagggattagggctagggcttcaacatatgaattttttctgggggggtgggggagacataaacattgagtacgtaacaggcagttatgttcctctctggaccactgattctgagcacagtccttggtagtaagcggacactcagaatgtttgttaaatgaatgaacaaatggataaatgaatgaatgaatgaacaaacaagtgaatacatgaaaaaaattatagtcctgcttgaacattgaatctggaggtcccccctagattttggaggaaccctgtgaatccacgtatgcctcaagaggtctttgtgacaacaggggaggctggataagacactattcagcaaagactctatcttttcttagcagtgacctaactggtagcaaagttgtggcttgctaggatattttgactttttctgaaacaaaaataaattttcgaaaaagaagaagaggaaaaagtcacgtggaactgctccgatctcccagccatgaaatatccctctgggattagatcccctgctgtgaagtattgccccatgattagatctcaagccatgaaatataaccatgaatttagatctcctccttggaaatacagtttgctgattagatcgcccccataaaatatggcctttgggttagtgcatgccagtaaaatatggcctttgattagatcaccgcagggaaggctgaggtgctagctgagactaggaactctcaccacatcctcacaaagtaaaatataaatatatggagaggaagagaaagcagaggaggtaaattaataacggtgacattttggaacttggactttcttgaaggttgtcagcgtgagggaagggatggggacagacctgggcgtgtagactccttcactgggtaacctggtgctggtgacagctggtgtatgaggctccctgtgtacccagaactgtgcagagcacttcatgtgtgttagctcctctagctcccaagaggaaggtgacattattatggtccccatatacacatggaaattgaggcacagagaagcaaagtcagttgatcaaggactcatagccagacgtgtcagagctggatttgaacttggcccctctgccccttgagcctttacccttagccactgccctttggttggcccagccgatgccactcctgacttgcggtgctagggcagtgtggctcccacaaaccctctgctgctgcaggggtgaggagtgaggatccttgtgagagtcagagatgagctggcactgcccctgggctcaccctgggtgaggaacagaacagataatcccagagtcagagcccagggaaaggccagggaggcccttccccacacttaacaggaagctcaggcccagagatgggcagtggcagcaggcccaaggcctcatagcggggtgccagcagatccagaccttgaagccaatgtcgcccgactttggggcaaacatccccttcttgctatgtagttctctctctcgcttgctgaaaggagcagaaaactaaatttggatcatgagtttattcagagagatggcttagtgtcatcacctcccagctcacttagtaatcatgtgagctggacattgtgctgggcaccatggtgcagccgtctccaacctttttggcaccaggaaccagtttcgtggaggatgaatttttccacagaccagggcaggggcgaaggtttcaggataattaaagtacattgcatttcttgtgcactttatttctattattattacattgtaatatataatgtaataattatacaactcaccatgatggagaatcagtgggagccctgagcttgatttcctgcaactagatggccccactgggggtgctgggagacagtgacagatcatcaggcattagattctcataaggagctcacaacctagatccctcactgatgcagttcacagtagggtccgtgctcctatgagaatcgaatgccgctgctgatctgacaggaggtggagctcaggtggtcatgtgaacaatggggagtggctgtaaacatagatgaagcttgcctgccattcgcttactgatgtgtggcccgtttcctaacaggccatgggctggtaccggatttgaacttggttcctctgccctggagcctttacccttagccactgccctttggttggcccaaccaatgccactccaggcttgtggtattagggaagtgtatggctgctgcaggggtgagaagtgggggccggtaccagtccatggcctgggggatggggactcctcccttggtgggccaccctcagccctcttcctggacagagaccctgctcacagctgatccatgtctgggaattgcccttgaaggtcaccgccagacccaaggtgatgctctccagaggtggcccccatctgtgctgctggatgaggacacaaagccctgcctcttccctcaattcagggaaagctggtctcagcttcagagctcccagtggatccacagccagctccctctttgcctggtctccacttttctgcagaagctgtcttgagagtaccgcaatctcctgcacacagctgtctatctcatggtctgtttcctaagcatagttgtccctctgcccctccgattccatctgtgaaatgggaatggaacacctagccagaggtagtctggaggcaagcatgccagtgtgcgtgtgatgtgtgcacaagattcctggcacacactaagtgttcataaatatttgccaaaatccctgccaggtcatctggagctgagaaagtcacagagaagggattcttcacctctattcatctgcaacgtggggccgataagcctgtcttatgggtcattgtaaactctgctgggcagtgctggggacagtgggggtgagtggttcctcctcagacttcatctctggtccctctttctttccctgcagggtgctcagtgaaagccccgggcagaaggctggccacttctttatctcacaggagccagccactggccagctgttatcggggatttgtgagcttgtaaaacatggccagctatcacgccatctccccagggcacagtgctttctcggctgggcctaatcaccgggtgatcttggcctgtgattgaggggagagctgggttaccctgggaaggcagcagccaagtcctctggaaaaggctcgggtgggtggaggagctggggggcatcagggccaggcctgctggggctgacacatcgctggaatggaccatggcagattccatgccccactcttccttcttctcttccctgcagggagatggtagagtgtggggggaccctgcgaggctccagggacccagaaggagataattccagaaaaaacattcagaactgcatcaatgtcagtggccccctcacccattcctcgttaagcacccactcagtgccaggccctctgctaggctatccaaagtgctggactttgctgtgtgacctcaggccagtcacttgccctctctgagcctcaagtgtccaataggaataatagtgcccgtctcaccaggttactatggggatcccttgaggcagtggatatgaaagaattgccttacaaactgtgaagtcctgtgcccataaggatgagatcaaaggataagcctgcatgtggattacacacctagaggaatggctttagagggatgagggacatctcagggggaccagagaaggactcccggagcaggagattatgtgaggctttgctgaagactctgggggaaggaggggttgaaatagagagggcattccaggcaaagggaatgggatccatacggtctgctgggcaggggatacacggggtgtgtatcccctggcgcgggagcacacggcttgagctgtgtggatctgtggcaggcttgcgggttggggaagccgggcccatctggctctgtttttctgctgtcattttggatgcttttgtgctgaattccccttttgtcactgtttccctgcgattttcttttgaacctggcatctgtttggggcttcatccggtccctgccccctgcgttctgaggctcagatctgtttgcaacctgggcatctgctcttagggcagtaggtggttccggctgcctcagcaggtctcagagccagggtccgggatgggtggggcaagggcagatctttgtggaaggcgctggccctgcctgacacaaacatgtgacatctgccctcctgagagtccagtaagaagctttcttcctccctccagccctcctgggccggggagggctgccacgctctgtcatgcacacctgtctcccccaccaggcttcagatggcagaagagcccagccttccccagcactggctttggagccacgcaagcctgggtggactcttggcgctgcatttaccacgtaagcatcctgagctaaacctccagaagcctctgtttcctgcctctgtgaaatggggatcatgctcccactttgtagtaccataaggatgcaacaagatcagtcttgtctaacaccttcttgcctgtggtcagcagactggggcatgaacacggctctgggccgggtctctggagtctgtatcttggttctttcaaggcatattagtgaatctctccctgtgcctcagttttctcatctgcaagatgggaataagacctgcttcatagaattaatggaagtactcgagtctgtatatctgcaacatactttgagggtgcctgaggcacagttagcgccatgtgggtgctcacattgtcatccctactggtgttgtcctgtgacttcactgggacccatagagggtaaggccattgccaggcttgcagctgggcatactggggaccacaaggttcagcatatgcaccgggatcctatggctgagctaagatttgagtctgtgtgctgagggctggagagcagtgcagaggggtgatcagaaggcctgggttggcatcgttcccctgcaatgaattatcttggtggacaatagccagttgcttccatactctgagtttaattttggtttccttctgccagaaaattgggataatctccctcctgaagtctctgtgagaattaaacaagaaaataaacgtgaatatcctttgaaagacataaaatgcagtgggccgattcaattcgtttattcgacacatattaattgaatatctactaagtgggaagtgcagccctggcgctgaggatctggggtgaataaggcaacactggaatcctggtcctcacaggccttcactccaaatgggcagcaggtagcaacccccaagcagagagacaagcacaccaagttcatggggctgagacaaggggaaagagaagtggcccacagggaagggggtgagggctgtgtccaggggcttttgaggaagggcatttgacaccgacagctgagtgaagaaagaacaagcccagacttgtggggccaggggtagtaggcagagggaagagcagcatagaggcccctgtggagaaaagaggcagtgggagagccagtgtggctggagctgtggtcaggggccagtgcttacagggccctgtgggccaaattcagaatctggaatctagtccaagggagacgagaaccatgggaatctgtattagccagggttctctagagggacagaattaatggaatatatatatatatatgaatttattaagcattaactcacacgatcacaaggtcccacaattggctgtctgcaggctgaggagccaggagtgccagtctgagttccaaaacagaggaacttggagtcctatgctcgagggcaggaagcatccagcatgggagaaagatgtaggctgggagtctaggccagtctaaccttttcatgtttttctgcctgttttatatttactggcagctgattagatggtgcccatccagattaagggtgggtctgccttccccagcccactgactgaaatgttaatctcctttggcaacaccctcacagactcacccaggattaatactttgcatcctacaatccaatcaagttgacactcagcattgaccatcacagaggctttggatggggcagggatggacagggtgggtgtttgtctattatatgcttatgtaacatacaaatatggtttagcctacaatggaacaagctgaaggggagtttccccctgagtgtgtgtctgtgtgtgtgctggatgctgccacacttgaggacattcaggaatcagaaaagggttggactagtcagcctcagtaagccctgtgacctggagattctgtggttttatgaagaaatgatcatgtgggctgtttcctaagtccccagagagtgaaagagtgaatgagtgaatttaggataataggaatttaggatgtgactggatgtgagagacgctggagcaaacaggtcagtaggggaagccactggaattcccacttccacaaaacagcagttctctgcttttggtaaagggaagagaaaggagaccctcctactgagttaaaaagggaggagagcgaacatgtttcatgcaggtaccatgtgcaggctctgtgctgaccattttacaaacaatccccctttgacccttattatcttagcttcctagggtgctatgacaaatgatcatagactgggtggcttagaacaacagaaatgtattcctttgaagtttggggactggaaatctgagatcaaggtgtcggcagggccatactctctctgaaggctccagaggaggatcctttctgcctcttccagcttctggtggttgccagaaatcttggtgttctttggtttgtggatgccttgctccaagctctgcctctgtggtcacacagccaacatcttcctgtgtgtctctgtcccttctcttcttattaagaccccagtcatattggctttagggctcaccctcatccagtatgactgcctcttaactaattacaactgcaaagacctatttccaaataaattcacattctgatgttccaggaggacagggatgttgtggggttcactagtcaacccaggagacccactcttttgacggagtgataatgtcaccctctgttctcagactgctaataaagacacacccaagactgggtaatttataaagaaaggaggtttaatgagctcatagtttcacatggccgaggaggcctcacaatcatggtggaagatgaatgaggaccaaagtcatgtcttacatggcagcaggcaaaagaccttgtgcaggggaattcccatttataaaaccatcagctcccttgagacttattcactgccacaagaacagtatgggtggaacagcccccatgattcaatgatctccaccaggccatgcccttgacacatggggattattacaattcaaggtgagatttgggtagggacacagccaaaccgtatcacgcccccacttcacagagcatccagaaagtaaagaaacttacttaaggccacagagctagaaagtagcaaagctggatttgcacccaagagcgtctttgatgagagtcttcactcactctacacagccaagctgtctccaggggatggaatgtcatgccagcctcggaacagcacagggaacttggggtgctctgggtgccatcgatggattataacggctggagcaggcatggagacaggtcagttgaaatgaagttggaatgaggatcagaacaggcttggaggggcagaggaaccccttcttcctcttccttcttctccactttctggaaccttctgaacctagcacagagaccaccatcctctaacaccttcccagattccccggctctgtgtgaatgtgttcccttgctctgagctgcccagccctgttgtctgtgcctctctggaatgaattccattctctttgcacctggcgttctctttggacctcctcaagaccagggcttgctcttttctcctgcattccctgcacctaacacaggcagcggcacacaacagctacactgcggattcactgattccacaggagtttttaaacacaattatgtgttcaaagcagaaaacacagaccggaatgaaatgaaagacagtctggtggggaccaagactcataaacagatgctggtccctagggcagtgcatggcaatagtagagcccagagagaagcctggtccagactatggtatgggagggaggcagagaaggcttcccggaagaggcagcagccagcgcaagtggcaggtgcagagcccttgggcaaaagcgagagctcagccttctggaactgcaagcagcttggtgatgctggggggttgtgtgcagagagacttgggaagggaaaatgttgatggagaggtccacatgaagaggctggggcttcatcctggggtatcccttctcttgagattgacagtagggttgaggaggatttgaagagtttaatcagggggctgaatgtggtcggatctctgtcagatatccagaggctggaggcagggaggccggggaggatgccaccttataatccccgagaaagatgccagcaggctgaatggatttggggttacagggaagggaggagtaatttgggttattactaaatgctcgttgagctggattctgtattgacctgcaggactccatctgacctaatggcagggaggagaggccatgccttggatacttcctgagtccctgcagggcgcgtctgcagaatccaagtgtgcagtgtgcagccaagagctcaacaaccaacatacttagatgtcagcaggagagcccagggtctgtcctcactgccaaagcttagcagggggctccacagggtcctgaaggtaccccctgaaaaattatccgtgtcaaggctgacctttattgagcactgtctagttgacagagtctgttagaagtgctctgttttatctcatcagagccacataatggccccatgaggtggtgctcttcttatatctgtttgatagacgaagaaactgaggctccaagcagggaagtgacttgcccaaggtcacaaccctaggcagtgacggagctgggacttgaacacatgatcttgagcctctcaagcccaggcctctgctgccacctctggaagatgctgttttcccaggaaggtgatatctccagtaagacacccttctatgcaagccacagagacaagtgggggagccgccccgtgcccctgtccagatgagtgaaggaagacggacgagctggcttcctctcttttcccggcttcccggtaccaagtatatattttttctaatcggcccggctgctgatggttatctggcttcgctagagagcgaaagagactttgtgtcaaatgctgaaaaatgacttttcaggcagcctctctgtctcctgaaaggaggtgacgtgctcagagcatacaaatcactcagcattcgggtgtctcgatgcgaggaaggagtgtgtttggattgctaaagccactcctgtcccttcacaaggtcatgggcgggcaacccagtcttgtcagtgcctggagagcagagaagcctggtgctgagaggtgctgtggcccccagatggcaagcctgtggggtgtctggacccaggaggggtcccttggatgcacaaggtacaagagtccaagagggaggctgacctcggattctaggtctccatcagcccacagtaagctgtgtgaccttggataagttacttaacttttctggtccttggaaatctcgctccataattatcatcccacaaatgctgttttcagctaagccattcaccctgctggatgttctaataactgcatttgtctggtgctgacaaatcctcagtgattcccaggcagcagaaacttgcctggtacctacagagaagtcactgggtgtgaaggacaaaggcagacgttggaatgctccagagagggccttgaatccaggctctggaggcagcctgtgggttcaaaccttggctctgccactcaacagctgggtgaccttgggtatgtgactttatctatctgagcctaagtttcctcatctatcaactggggaaataaccaagactacctcatattggggctatggtgaaagccaagggcttagaatgatgcctggaacaagagtaagtcttcagccagtgtcagctcctgtcactgtgactgtgtcttagctgtgctgacgtggccactggcttctataagaatccagtggattcttggaaaggtgtcgtaacctctccaaggcttggtttcttcatctgtgtagaggggatggggatttaaaaattcaatgtgcttaaaatgcttggcacacagcagtttcttaatcacttgtagacatttctctggctctttgcagaaagatattttaaataaaatttcagttttcaagtgtatctgatattttgcaatcctttgaaaatttataaagatgatgtacacagtataatctgtctcgaagtgaacacggggttgactggacaatgccattttctgagtggccataccagagtaagagcccactggagatcagaacttgggggagagtgcccagagccagctccagggagtaggacctgcccaagtcataagtggcagctctgggtcctgcctgcctctcttcctgagatgccatttatagctgccgggacccacatgggcccgtagggtggccctgcccatgcagagaggggagcagctgtcattgtaagaactgagtgagcccaggagccaggctcccagggtgccaagggatcgtcgtcattcatctcccccgtttttattttcttcactataaagcatagaaaaaccacgtagccagaccttaaaaaatacagacggtctccagatgagtctgtgatgttaggcaaggcctgccaggcgctttcttaatgctgtaataaaactggctggggaaaaactctaaaattacggaggaggccggcagtataaaatgtatgggatcaagagagagagagagagcagagtattgcagcagttccacactgggccccaggtggaactgggctgggtcatccgatggcagagtgacgccacttctgtcaccacccccctggccctactttactgctggggtgttttgaggatctaataaggtcgtgggagtaataggctttgttatttacaaataattcgaataaaaggacaataggaagacctctcccctgccccctctgcccagatgcccccccaaagcaagacttcttgatggtggcaggttccatgggccagatgagggtggccccctgggactctctgtctttctcccctgcccatctcactggtcccccttccccagcgggccttggactggggtgctttggtgcccgtaaatgggttgaatgaattaggcccatgtccttctaaagcaaacttttaaaaaatactcagttttgcaaggccccccggtacattaaacagatagaagggagggtggctctggtgaataaagagtgggttggggcccctgcacccatcagtggcgtgccctgagttcaaatactgtccctgccactcaccacccaggggatgtgtttcagtgtttcgacctctcccagcctctatcgcatcatctgtaaaatgaggatagtgctagaactcacctctcatggtggagattcagtaagacaaaagatgcacctggctcagagtaaactcctcagatatccccattacaacaacggctactgtgatttgactgctgttggatacacggacatccaggcgcccctcggatcctgggcaccggctcttgaagtgccctcacagaggccctgtcaatccaggcatccgactccacagttctcagcttcccagccctggtgactccactgcctcctctttggccatctgcatgtgcgtgatgggaagctgtgcctgtgcctctcctcggtggctgcggtaatagagcccagagtgagcaggtggcagcccccctcccccttccctggtctccctccctccctatctctcacctcggctgcaaagctccgactttatttaatcgcttccattgtctgctccacgcctggtaatctcagctgggaacacatgttaacaaatgggcaaagttttatcgggagctcagagcccctccccgcttcgtcagataaggtgctcttgcttgggggctcacactagggaagctgctcccggcccccccctacccccgtgagaatccatccctaggcaattgcattgtgtgagcagggtaacaggagggatgggtaggagcgggtccaagggggctctggggatccagacaaagaccccaagcccctgctccttccccactcatgggttctgctgcttctcctgctggctggaagacccttgagattctgcccattgtgggacagtgggaaggcttgccttagttcttggttcacatccgggctcttgcgtcttcccaactgcatgatggtcacttccattctctgcatcttggtcacctcggttataaaataagaaacaagcctatctgtctcctgacaaagagagtttaagtgaggttatgtgagtgaaattatctagggaaatgcctggggcttagtaggtagacagcgcccccctttgcttcctacctgaattagtttcctaggactgctgtaacagtgacttaaaacagcagaagttattgtttcacacttctggaggctagaagtccaagatcgaggtgtgggtgggccacactccctctgattcctgcagggaataatccatcctggtgccttcctagctgctggtggctgctgcaattcttggtgtttggtgttcctgggcttgtgcctgcatccctccggtctctgcctctgccatcacgtggcctgctccctctgtgtctgcttctgtgtccaaattccgctcttcttataagaacattatattcaattcgggcccttcttcatcttaacttgattatgtctgcaaagaccctatttccaaatgaggccacagttacaggtgtagggcttaggatttcaatgtatcttttagagggatatagctcaccctacaatgctaccttttggctaagtcttcctaacttgagtggccgggatccacgttgcccttggatcagcctctgtcactgagctgaccctgctttgagtttcacgtgatttatgtcgttgattttaccccagccccatgaggagggataatgaggaggggtccacctttgctcttctgctgcgctatcctgttctgtgctagggatggatgtaaacagataatagtgtttacatgagacaggggccacactagggagataagcatttatggaagcaaagatagtgtccctttctcactaagtggaagtgaaaataggaaggctctcgagagacccactgagctggtcctggaagggtaaagaaggcattctgggtagaggaaggagcttgagctggggactggaggaaggagcgcccctgagctgtctcagcatgggtgagcagccctgggagactgagtcagggactgagcgcgtgctcagggaaggatggagctccctggaggtcaggctttaagggcagccgggctgacactcagaatggccaggctaagaagtgcagacttgattgtgccagcactggggagccagtgaagattgtggaactgagacatggtaggagcagaatcgtggctccaagggctaatccagcagcaaacacatttcaaagtttttgctgaaggaaagcctcaccacggagggacacaacgagcactggaatttcaaggagctgtggaagtctatcatccagaaattccccagaggaacctctagcctggctggatggacagcacccatgtcaactcagcctcctggtcctgattcctccttcacgctggtgagggacaccaggcatggccccaggatatctgggagctgggacccacctgctctcccttctaagggaaatagcaaggaacaggtatctctggactttgcctcctctgccctctcattggggtgtgtgtcggggggtctgtccgttactggcatccctctcccatcccatgccgaagattttgacctttatagccaagtctgagctgtactgatagaacatccacaaagtcaacagtgggaaggttccacaggcccaagcatcccttcctgtgccttacaagtggaatcatttatttctgtcctctaatcttgattaaacccatctgaaaataagttagatatcaaatctgtgatttcagtcctccctccgttcctgaccctcttctccctctagttgccccaaaagtggccagttttgttcaggagagcaccaagcacttggaaaattccattcccagccttcccagctcatttctgcttccacgcaccctgctgcctcctgacagtctcacttttaactctatttacattctggaaagtacataagatttttatcatgtactttcctaatgtcaattttcccctgatgagaataaggctgtaaacacccatattttcataagcctgttatagtcctccatgtattcaaagtcgatgagcaatgcaatctcacattctcagggctggctgggactggcacaggaggacggctcaaggcaaactctgggagccaaactcctaggtgtcttctttgtctttccttgggttaccaccttcattacttttgggggcccttcttttatgcctaaatctgggtgttccttctttttcacactgctataaagaaatactcaagactaggtaacttatacagggaagaagtttaattgactcacagttcctcatggctgaggaggcctcagaaaacttacaatcatggcagaaggccaaggagaagcaagcaccttcttcacagggtggcaggagaaagagagagagagagagagagagccaagggggaagagctatttgtgaaaccatcagatctcatgagaactcactcactatcatgagaacagtatgggggaaaccggccccataatcccatcacctcccaccaggtccttcccttgatacgtggggattacaggttgagatgagacttgggtggggacacaaagccaaaccatatcaatcagtatatctatttttggttggaaccatcaaaacctgctagactactcttaagctgtgggaatggacaaacaccaaaaatggcatccagagaaggcacagactatgcatcccctaaaccttgttatcccagggaaaggtgccatgggcctggtccattagacccatcccagtcttggctttgggtgagggacaccattcgtgacactctacacacttctaaggaagttgggagtggccaggctgcatcaggctagctgggtaacactgggatttgcaagcccctgagcctctgggtggttgagtgggctttctctagaggacatcacaactcagttactgagacgttttcttatcaatctagttttactgaaacctcatggtccttcctgctgagcccacttgttgcaaggctaggtggggaaaggctccagggatgctgcaacaagcaggtctttgcctcctcaagtctagggacatgactggctccacctctggcccttgataactaattgtttttgttttgttttgttttgtgttgtttgagaccgagtctccctctgtcgccaaggctggagtgcagtggcgcgatcttggctcactgtagccaccgccatccaggttcaagcgattcttgtgcctcagcctcctcagtagctgagactacaggtgcatgccgccacacctggctaggttttgtatttttagtagagacagggtttcaccatgttggccaggttggccttgaactcttgacctcaagtgatctgcccgcctcagcttcccaaagtgctgggattacaggcgtgagccaccgtgaccagccccttgataactaattgttaatgaatgaatgaatgactgtttgtatatccttgaatctgaagtcacttcattcaccagaatgagagcagcagagtctgctatgaaggggaacaggtggggtgggggcgagggtggtcagaatcctgcctccagtattagttctttctaagcctggggtcagcacattttcctgtaaagagctagatggtaaacattttaggctttgtagtccacagggcaaaatcgaaactgttatgtgggtatttgtatatcatttaaaatgtaactatttataaatatgcaaatcattcttagctggtgggtcctacagaaacaggctggccaagatttgatctggggccatcgcttgccgagagctgttctaagccttgtttcctttatctgtaagatgtgaccaacctctgtttctgagggtggttgtgggtattccatacaccagacagaatgtgcctggcagcgcttagcacatggtaacaccataatcctaaaagccctatgggatggagggcttactcccaggcactcctctgagaatatgaactcataagctcctctgaccccataacataggtactgttcggtctccattttacagatgaagaaactgagccttagaacgatgcagtcatttgcccaaagttacatgttggttaaatggcagagctgggatttgaacacagggactcagacttcagagcctgtgctcgcaacttcagtgatcagcagctgcagtagtcattgttgctgctgttaattatccttctcagggatccaaaggaatctaaaacgagccaggacaggaacactgccagaaaatggatgatacaaaaatcttccttctttgagtgtggcgtgcgctgcttggttttatttggccaccagttcacctcttgggttaccatggcttgaatctgttggtttgacgtctctgaatgtgtgctcagaggtggaggggagatgaaggggagaggggctagagaaggctaggtcaagtaggagggccatccagtttacaaacacacaaggcagtgtgtgtctgatctcccttggagcatgacagctggcttctctcagtcctggaaagagagatttaggttgggcaggagcaggaactagagaaacatcctgagaatggatcacattcaattcatgacctggttttagcccagaggcagggggatgactgagttgacctttcagggctacatcctgtcttcctgttgggcttgggagtttatgacttgcagagaaaaactactccataggtacaaataccttccttacagttcaggtgttcaaaactcccttttcgttttttgtttaaaataaactgatgttggacacacagcctctgagaggatttccaaaaactcctggaaaagttttagatcgttatcatgtaggacagagagggattacatttacatgtcaaaagatgcaaaggccacagagtcctgctaaaaagttgatggggagagagaggaatgggggagagaagaaagataagaaggggagagagagagagagagagaaagagagagggagaggagagaggaggagagagagaattctgcaatattaaccatggctttctctgtgtagtggtttatgggagaagatttttgtttttttatgattacctgggttattttttattttctacaataaacatatatgattcttgaaatcaccagagagagatgtcattaaagattaaaatattgataagagtgggtctgtgcctcttcttccagagccaggtaggagtaggaagctacctttccagcgagaaaaatcatcctgtttgtacaggacacgtttgtcatccggtgtttccttgactccctcttatcttgctgacaaggagaaggatggaaaagggactgtgatcgagtgaggcccacggagcatgactcaaacaacccattgtgaaggagggtaatcgcagaatcagctttggaaatcaaataaaatgccatgtcttgtagccaagagacactgcccaagcgtttgattttaagctcagctgaaaccctggagtctgtcttgaactgggaggaggactgactcaaggtgggactaaggtgatctatatgaagaattctaataaaaatgtagattggaatcagacttaggagaaattgtgaatgataactgtcagggattcgtgagaaagattcaaaattctacctacggggttcttttaaatgcttgccctgtatgatgatctcttttaatgctatgttacagaatggttgggttgatgtgtcattttcaagaagcagtagaaagcacttaacactatgcctacctcatcataggccttataaaatgtcaacaattcctggatactgtttcttctgctggacacactacagtgaacaaaatagacaaaacccatcccctcatggggctgacattctagtcaaggggtagataaattttaaatatggtgtcaggcaaagatgtagtgctgtaacaaataaagcaattttcaggatagagagagaggttagctgggaattttagagcatttgagactgggtagtcaaggcttctgtgggttatgacattgaacagagaccagagcaaagtgaacgagcaagccatgtgcacagctggctcaaatgtgttctggggctgggtgccgtggctcatgcctgcaatcccagcactttgggaggctaaggtgggagtattgcttgagcccagtagttcatgactagcctgggcaacataatgacaccctcatctctacaagcaataaaaaattaattgggtgtggtggtgcatgcctgtaatcccagctactggggaggctgaggtgggaggattgcttgagcccacgagttcaaggctgcggcgagccatgatcgcaccactgcattctggcctaggtaatagagtgagaccccgtctcaaaaaaaaaaaaaaaaagagtgttctaggaagatggaacagtaagtgcaaagaccttggtgtgggaatgagcttgggatgtttaggaatgagcaaagagtccaatgtagctggagcagagtgggcctgagaaagtggtagaagtgaggctggagtgagagctgggtgcctcaccgcacaggcttctgggccatggagaggactttggctctgactgttcagtatgatgggagctacctaaaggcttggcacaaaggagcagcatgatctgcttgatgcttcagaggactgctgctatctcagataaacatgatgtattggtctgctattgctgtgtaacaaattactacacacttagcagtttacaacaccacctgtctattttctcacagttctgtagcttagaagtctgagtaggctacactcaggtctctactctggggctcacaaggtcaaaatcaaggcattagctgactgggctcttatctggagtcttaggagcaagaatccacttccaaacccatttaagttgttgcagaattcaattccttgtgggtgtaggactgaggtcccggcttccttgctgattgtcactctcttctcctgtagactgcctgcatttttcttcaaagacaatgagggcatgttgaatccatcttggactttgaatctctttggcctcctctcccatccctagagggagaaaacttcccacttttaagggctcatgtgatgagaggaggcccactgggataatctccctatcttaaggtcaagggtgtcatgtaacattacatgatcatggagtgataacccatcatattcataggttctggtgattaggatgcagaaccttagggaaggggatcgtttttagaattctgcccacctcatgtgaggcatggtttagctctccttgcaggaaaggcatctgggtatgtggaagactctctaatatggaccatgaaatccagggttacaaagtcaggactacaataccagtccttattgcactccctcaaagagcatttattaagcacttctgcattcctaaaagtgttttgcatgatgaaggatttaaaacaacagcagacaattgcatatcactggggagctgaaactaatgatgcagaaagcaagtactggatttggtaaaatgcaagggagctcagtgctaaaggatgcaaaggcaggaagaatctggcaggggctgggattccctgttgacacctctcccaccagaccagtccatgttctggtctggtgcctggctcagaaactagcaggtgtttcataaatatttgtccagccagtgcatgaatcaatgtgcttcagttttcataccagtaaataggagtattggcctccccacatgtttgtgggaagatcagatacagaagggctgtacacttggaagaaaaaaaacgggttcaaaagtcagtgtcattatttttgtgagtggcaggaattcgctttgacatgcccctgggagagagataggaattaacaaccacatcaaatgcatatcattggccaacaggggagttttcctaagggaagatttatcggaaaaagtttgggttggtggaaggaatagcacagatgcctgagggcccctgggaggaagggaaggggcccagaggcctggtgggcatgctgaaagcaaccttcaccttcttcataacccacctgatctccttgcccagagcagaattcagttcccctgggaaggaatgtgctgggaagcaatttttccttcccctgggaaggaaggaaaatgctgtccaaaggtttcgggttttgggcagttctccttcagtttaggaataatatatatatatatatatattttttgagacggagtcttgctgtctcccaggctggagtgcagtggcgcaatctcggctcactgcaagttccgcctcccgggttcacgccattctcctgcctcagcctcccgagcagctgggactacaggagcccaccatcaagcccagctaattttttttttttttttttttttgtatttttagtagagaccgggtttctccatgttagccaggatggtcttgatctcctgacctcgttatccgcccgcctcggcctcccaaagttctgggattacaggcatgagccaccgtgcccggcccagtctaggaataatatcttaataccaataacagacttttctcataatagccccaaactgaatgtccttcaatagtacatggaaggaataagtggattgcaatatttcacacaatgagatactaaccaggacacatttttttgaaagcacaaactcctgataaatgcaacacatagaggaatgtcagaaacatcatgctgagaacgtgtagccagatgcaaaggggcacatactgcaggattccaggtatgtgggctcaagaaaaagcaaagctaatctatatggagaagccagcatagaagttatcgtgggggtgaaggtagtgactggggaggaaggagaaggtgggaactttctgggtttctgggaatggttgagtggtgtctacatgagtgtgcacataagtaaaaatgcatcgagttgctcgcttgagcatttgtgcatttaactataaattatacctacaaaaaggaataaaatcattacaatagtggtagcatcaaccacattttgagtgctacattagcactatacagctattatctccaaccttgggagataggcattatgattcctgcttaatagataaaaagactgaagcttcctgtgtccaagagcatagttaggaagtaacataacaagattcctggctgctttcttggcctgtctcaatgcctttcctatcaggaaggccaggtgacctgggcccagggcctacccaatacctgcatacagagggcccgccttcttttcttttctttctttctttttttttttagacagagtctcactctgtcgcccaggctggagggcaatggggtgaccttggctcactgcaacctctgcctgctgggttcatgcgattctcctgcctcagcctccctagtagctgggaatacaggcgcccgccaccacacctggctaattttttttttttttttttttagtagagacagggtttcactatgttgggcagactggtctcaaactcctaaccttgtgatttgcccaccttggcctcgtaaagtgctgagattacaggcgtgagccaccgcacccggccaggcctgctttcttttctaaatggtactggacagttggtggagtgtgccctgccctggtcctgtcatttcttgtccctggagacaaacctgccccagacacggtccatgcatccgttgccttgaggccccaggcctttctgtcttcatgtagaatctggcagcctgcagattgggaataaatgatcttctgttcaccccaccccggcccacttgctcctcacccaacccctccattcaatgagacgtctacagtctgcacctgggccttcagcaggacgaagttagatggtgtgtgaatcaggtacaaatagccttcgggtgacatccaggcactctataaccatgcaactgtaataggctgatgtttctcttgctggatgtaggatgtatgcatttaatgaagtattaatatgaagaccggattgcttctcctgtcaagtggaagaacgagattagagaggagagagaagctgggtgctcccctgggaagagggatcccccccagacactctcctttgtgagccaggactcctttgctttgcagaataaatgcatcctaacagagtgactgtaaagggactttctcataggatttttgcattgcaaaatcaaaatatgttccagagagcaggaaagatgctcccatggagtgagtggatctagtttagtggcaaagaagtttggctgaatgtcaggtgttaggcatagctagtgtggggtaacgtttggggagaagttttccagtaatccatacttccagctttcgacggccggtcctggtgttggagactctctctgctgtgctagggaactcctgagtccacgtgcatacccccctgaagtttgttttcttacctttattgcagggtgtctcagcctcagaacttcttgtgcttggagccagatgactcttggttgtggggctgtccccgcactgcagggtgtttagcagcatcaccggttcctgcacaccagatgccagtagcgcagcccccctccagttgtgatagcagaaaatgtcttcagacattgccaagtgtcccctgggggtcaaaaatcacccctggttgagaaccactctgctttcttgaaccatctctttattttattttattttattttttggagacagagtctcactctgtcactcaggctggagtgcagtggcgtgatctaggctcactgcagcctccacctcctatgtccaagtggtcctcccacctcagcctcctgactagctagctaggtttacaagtgtgcaccaacacacccagctaatttttgtgtttttagtagagatggggtttcaccatattagccaggctggtcttgaacttctgtcctcaagtgatccgccctccttggcctcccaaagtgctgggattacaggcatgagccactgtgcctggccttccctggaccatttctaacggctgctagagtggagatgtgaaatctccctgggccagtcgggctgttgccctgataactaagctgcccagcttgaagagtctgaactcaagagctttgatcctgcaagaagagtccattcccttgttcttcagtgggaaaaccctgtcacctgagttcatttaaaactgatgcaaatccagagagcaaagccacgctgcattcagaacatgtcttaagacaataggttcaaggaaacagcgttgttactgagcaaattccctttgcaaatttccaggcccttccgtgccaaagcaaggtaatccagtttaatgcgagttgcctttttgggagagaaaaataaaaggcaaaatatttaaggattcctttattctgcttttagcttctgagcccagcaattaattcgtatgtgctaaaggacttctgtgtttatgaggcattattatttaatgtaggcctattttaaattgtaatttttttcattaagttgcctcttttcacttattaagaccagttttataacctagcatagactgtattccttgagtaataactatttttcttttaaaatattccttaataacccatcatccatattttaaattttattctgagtcagagatgcctccctgttgctcacacgtctctcctcatgattctgagtaatgttggaggatacagggctgccagatcctctgccagctttgctttaagtctcagtgcagaaagcgaaacagcagccactggtgactgcccagcctccacgctcctgaggcccatgtggagcagccaacaggttgggccatctgcctcacagcttcccagcaatgttccataaggcaggcttgctgggagcagctgatgggggtggaggggcgcagagaagtgggatagctgcagggagctggagcatggcagggcagtgaatcccaggtcatctgcggcagcacggcccccgggtgccgggcacagtgctatggtccttgcctgggccatctctctgcatctccccttgccagccttaagaagtaaagagaattatcccattttgcagaagtggaaactgaagctcagaacagtggcgtgacttattcagggttgcaaggctagcttgtgatagagtcagaagctgtccccaggtctgtctgattcccaagctcaaagttataatctctcagcactagtggtcctgacaattctcctacaagcaatgagaccaacttctccaatagaacatttcagaacaccttccctgctgttctcatcttggcatcaccattgtcctgagaaataagcgccatgagcccatttttccgatgagatagatgactgaggcccagagaggagtagggacttgccctttgtgtccatggcagaatgagggctagcccggggtcttctgcttcaaggtctgggctgctttcttttcttcctgcctcagcctgtggtttccctattgctgactgcaccaccagcccaacccagggggggtcctggcccctctgctcaacatgcccctggccctggagagggcactgcaaagacagccatgggctgtcagggcacctcacaagcatcctgtggtcacattggtctcagccctcctccctgtcagcagtttcagctgttccttggatgcaggattgacccagggttaagaaaatgggaattcccctcacccaccaccaaggacatggagaaagttccagagggtgaccacaggctgtcagatgaaagacggtcagggaaaagacactagtatggtagaaaggtcataggactgtgctttaggagacaggggtcctggtcttgagttgcctgttaattggctctgtggccttggcccggggctttctcttccctgggccttgatttatccatctgtgtaacaaaagggtttcaattccagatccttaagtcccctccctctgatatcctgccatgggaaacctcctttgggatgccaattcagcaacagtatggccagacccactgatttattttgttgctttttcattcatcttattcattcattcactttttttccaccaagaacgttattgaattcccactgtatgcaatgcattagtggaatgtaatagtagactaactgctgtaacaaaccaaatttcagcagcttaacacagtggtattttatatcttattcatatcagggcttttggggaccataggaggacttggctccatacagtcattcaagtacccaggtttctttcatcctttcatcttatgatccaccctctgccaagtcctcagagccctccccaccctggtgatgaatggagagagagggtgtgcaggcagcatgggaggtttctaggggccaagcaggaaagtcatattcccctggccaggatatagtcacatggccctgccaaactgcaagtactgcctgagtagctaggagggaaaggaaatggagtgtggggagcacacggccatcttcctgggtctgggcaacacacacacagcacagagcaaggaccatgtacaagacagaagcttcagatcccaatttgagctcgggtgaaggagtctgggacaaacacaagaacgtgaggtcccaggtggacccggaattggcaggcccagcattgcatcccacaggaatccctctcatcagcccaggatctgctgcctaaggaagcttttccctagtctcatcaccttccctgcccaacacttcaaaggcctgaggactgactgagcaagtcctgcccttctctggcctcattgtcacccatccataaaatgggaagaaaaatgaccaacattagctttgcagggaattggaggagcatcaggtgtctacaaagggccatagaacagccttcccaagtcttattaatagtataagcatatcattatcaataatgaaacacatattaataataaataaacaaactaatgataaataatacatacatcatgaataatacattaatcctacaagtttttgaacatctattgcctctgacagaggggaatttgattagtttgctggagattagagagggggaatatttcaaaagagcccgggaggtcggggcaggggatggatgccagaaagcaccggggactgctccctgcaaaggctgtaaatcatttgaggtccctggtggcccagagctgagctgacctgttaggggaggtgagaaccaggaatcttgagtgagatgctccccctctgatgttctttcatggcccaaatttaggatgggaaatctatagctcaataaggcaaaaagtatccagccgcagcaaaagtagagttcatggtccaggctgggccagttgaacatacctattatattagtctgttttcacactgctataaagaactacatgaaactgggtaatttataaagaaaagaggtttaattgactcacagttctgcatggttggggaggccttgggaaacttacagtcatggaggaaggtgaaggggaagcaacgtatatcttacatgcaggcaggagagagagaaagcgggagagaaagttccacaattttttgtttttgttttggtttctgttttttgagacggagtcttgctctgtcgccaggctggccaggctggagtacagtggcgtgatctcagcttactgcaactttgcctcccgggttcaagcaattctcctgcctagcctcccaagtagctgggactacaggtgcacgccaccacaccaagctaatttttgtatttttagtagagacggggtttcaccatgttgggcaggatggtcttgatctcttgacctcgtgatccgccctcctcggcctcccaaagtgccaagattacaggcgtgagccactgcgcctggccagtaccacacttttaaaccatcagatctcatgagatctcactcactcacaagaacagcatgggagaaatctgcccccgtgatccagtcacctcccaccagatccctcccctgacacgtggggattacaattcaggatgagatttgggtggggacacagagcgaaaccatatcacctgtagaacttattagttcattcatggattcattcatagattcatggattcattcattcattcaatgtgtcctcaatgccagtagtgtggccagcaacacgcaaagcactaagaatgtagtaacagagacaggcatttggcccgttagaggctcccagtctgctgtgggaaacagactggcaaaaagaagtgtcctcatgcaatgagttagggctatggtagatgctgtgagagggccacctaacccagatttgggaatgctgggcatggggtaggtgaagctggagtgtacatcaggagtggtctttggggtaaatgacatctaagctaagacctgaaggacatagcgaagtgatgggggcaaagtgacggtcttccaggccaaaggaacggcaggtgcatagacccagtggcccgatgcagcctgacatacttggggagctctaagtaagtcaggatggctgtggctcagggtgcaaaagatagaagggcaagagatgagcagagcaggaggaagacccatgagtggttttgtataggggtcaggggtttggacttcatcccaaaggcaacagggagacaaagaagaatttggatgcaggccaggacatgagcaacctgggctacagcataatccacattgttccagggctccatggctcacaaatccccgtaaggtacagtgttcatgtcttggttcattcattactttatttgtgcagcacactcactgagcacccatcctgtgtcaagcattatgcagaggtgcataccgggtccctgggcttgagcgctagtctgatgtctgagacagacacacgaagaaccacatgttatattacaatggaatgtgtttgggctgtgactgagatgtttacaaaggtctatgagctcaggagagggtgtatcagactcatatcagtcaaggagggggtgaccatcacattgaacctggaaggatgcaaattaccctaggtgaactcagaggagaagggtgttccaggaagaggaaacagcacagggaaaaataattggaggggtttggaagggctgatgagggtgctgcaaggtgggcaaaggcacaatgtgagactgattgagttggaggggcaaagagaggcaagctcataagggactcagttggccatgacagtctgaactttatcctgaattggaaggcaatggggcagggaaattgaatggcattaaccagagaggtggcatcatcatatttgcattttagaaatatcattgagattttagggggctgggtaccttagagggacaagtttgggggccagagaccagtgagctggctattgcagagttccaccaggagatgtggagggtccaaactgaggccagattggtgcagagtggagtgaaaaagacagttgtgagagttattggagaagcagaattgatccgtcttagagactgatgacctgttagctttccccctctttatggagtggctttcttttcttaaaggcactgcccactcctggccccacctctcacccttttttcggccaacaaggaggtagatggttgggagtgcccattagtccagcatggaagagtgtatttcacagaactctctgtacctgcctagaagatatggttgcagtaattggtttgttgtaataatatttattacaatagtaattatgtagcactggaacccagggaggatgtccttagtgccaagatagggtatttgtcttcatgagataggggtgacctcttttcttcatgagtggtagtgcgtggagctcctgttatcacatggagataaattccagacccacagcagggggagggtggtgcgaggaatttatgtggccctgactgtcatggtccatcccagcaagacctaaaatccagctagtggagctgctgccaaccacctgaccacccgtctgccccaggtcaagttgtggtgtgatccacaatggttctcttaggagataagggtccttgaattcttgtcaccactgctgcacttccagatgcagagtgggctgagaacctgtccctgctctcaggaactcctagtccaatggcagacatacccgctgccccctgaggaaaggatggatgacccatgttgcttttcagtcttcactaattacttgctatcaataagtaatggtttgggtgatacacggcagacacttctgggccaaaataactggtcctgagctaggttcagaggactgtgtgtcagagatgtggcggaacaaattggccagcccagccacaagtctcttacagttccagagacgttctcagtcaaacacaacttcctggccctccttgcagactttgctggctttgaacttgaaaatggcctcagccatctgtcttcctgctgccaccttgtggatgcattgtgtcctgtgactatagcagggtgcttgaccctgctacactccagcaagacttcttgtgtccttcctagcccgtagtcccactacccactacccactcctgttttcagcttctccatttagaagcaagggggagtgggttgccatgaggtggtgggaagagtgttggactcagagtcaaagggcctgcctgccaagcctggttctctgtgatggtgagaaagtcactctgcatctatgagcctcagtctcctcacctgtagaatggggacactatccgacagggttgcaatggtaatcaatgagctagtaattacagaaatcctttgaaaactgccaagcactggtcacatgttcattttttcattccttcaacaattatttattgggctcctactaagtgccaggcactgttctagattctagggatatagtagtgttagtccattcttgcattgctataaaggactgcctgagcctgggtaatttataaagaaaagaggtttaattgactcaaagttctgcaggctgtacaggaagcatggctgggaggccttgggaaacttacaatcatagcagaaggtgaaggggaagcaggcacatcttacatggctggagcaggagaaagtgggggagctgctacacacttttaaacaagcagatctcttgaaaactcactcattatcaagagagcagcaagggaaaagtctgcctccattgcccagtcacctcccaccaggtccgtcttccaacactgggtattacgattcgacatgagatttgggtggagaccacagagccaaatcatatcaaagtagtaattaaacaacacaaaatcaaggacttccagctctggtgagatgaagtgaagacaagcctcatttcatctttcactaattcaaatataaaacctaggcagaatatatggacatctatttgaaaaatctgaaaagtaaatactagcagatggattggggaaaacactagaatcaaggtgccacataaagaatgaagataaataaaacctacagtcttactgggtaatacttaaaaagtgcagaatacaaatgaaaatcacttgatacacacacacaaaaaacccatgaaaatctcaactcacatggggaaagaaaatcagtagactacaatgatgagatggcacagatggttgaagtatctgacagagattttgaggcagctatgaaaatgcttgaacaagttatcaaaaacagtcttgaaacaaataatgaaatagaaaggctcagcaaagacatagaagatataaagaagagccagttgaaaaagtagagctgaaaaatacaataaccaaaataaaaaactcactgactagactcagtagcagaatagagatgacagaggaaagaatcagtgaacttggaggtagatcaatagaaattatccactctgaataacagagaaaaaagtattgaaactcacacacacagtctcatggggtgtacagtctagttggaggtcagggatgtcaacagacaataaacaagtaagtatatgtaggcagtgataaacgtctaagaaggagtaaagcagggtaataagtcagagagtgacaggggtgctatttacatggggtagtcgcaagagtcttctccaaagtggtgacatttgagcagagaaaggattgagggattgagccatgtgggtatctagggaaagattgttctggaaggtgggagcagcaagggcaaaggccctgaggtgaggatattcttaggaagctcaggggccagcagcgttcattgtgagtagagaaactgaatgaattcagagtgaggggagctgaaatcagagaggtagggaggacacagggccaggtgaaggcagaacaggtgggccagtgaggagatggagcagtaggtgaggaaacaaatgatggtggccaggtgcagagagatagcagcggaggggtgagctagttggattctgcatatattttatagagcttacaggccttgctggctgctttgatgtgagcatgagaaaaagaggaggttccaagaagtagattggtgtgctctgagctccctgattggcaaataggggaaacatcacatcattgtagggcctgtttccttgtggtgcctggagacaaccaagaggtgcatcaggcagtgatggactgccttacagcagggttccctacccaggacttaggcacgggcatggaggatgtttgcatttctaagtgtgaagtttcctggctaatctgagtccatgcatctgggcttgtgagatagcatgaagaaccacaccctcatctgctgcaagctcctttgttagctcccctcatggcaaggaaatgggagaagccaggaagataggacaaaagctcagctcactgtgaccaggagaagcaggatattgttcaggatgcagcagcagctcctcttgcagccctgagtctgctggttctggcactcacctgctgaggtgggcaccaagtttcttgctcgagggccttgttgttatggtggttcagttaagtgccactacctgtagatttgtctgccttacagtctctcccttaccaccgtgctgtctgctgacgcatggttaacgtctcatatcctaccatcctgagtgagagaacctgatagggtggccactcaccactcagtgctgatttcctctgttggatgcagttctgatgcttggtttcatgggaggctgttggatactccaagctggcagcagcaccaatccaagcagatgtggtcagagaagcaggttcagaacacacctgaggtcgggggagactttggctcaggctgcttagggaaaagcccattagaaacaggtgcctctgtgagggccctcctgggaattataaaacagtcaagggaatgagtagaatccatttgtttctttcttcaacaccatctttgatccaggtgctgttctaggcacctggggaccatagcaaatagaaacagttcatggcctgtgttgaggtgagcataccctgaatatgtcattacaagtaattttcggtgtcccaagcagtaggagcaggagaggcaggagtgctttgaggactatggaagtttgaggagttgttttcttgaggaggtaacatttttgtgaatccttgaaggatgcccaggaaatatccaagttacccaagtgagggagagggcttagggcagagggacagcctgtgttcaggcccagaggttagaggaggctgtgtgtgcaggagagcagaggcagcaggccctggatgatgagtgagaggtgccagaggaacctgagagctaggcatgggccagatctccctgctgggaggatgtgcaacttttcctatggagcaatgggaagctcctggagaccctaaagaaagccaggggcgtgcatattagagaaatgatcagggaccatgaatgggtgcaggaagcccatgttgcatactttgtcaccaccaccaccaccaccattgtctgagaacccaagagcagccatgctctgaggaggggattaccattcactttccttcagctttacaccgagtcaagggaggcatcgttacccctattatccaaataggcacagaggtttaagtgaattagccagggccatccatggaccacggtgaagttataacaagggtgaaaactcatctcggtttgccagaaacattgtcagttttaggtgctgaaagtctctcgtcccaggaaaccccctcagccctgggcagatagggacatgtggtgactctaacataatttatgtctcttttcagagacaggcccatatccctctcatggaagccctcgctgaccccgtcccctggggccaggcctgagccagccctctggacacatccccttggagctgggaaagggcggggagtgatgtcgggatgttgccaggagagttcctgggtgtaggagctatttgtcatcacctcattagaagggtgccaggttcctaaatattgcccgcgattttgctaaatgtatctgaacaggagtggtgtaaacgctgtcagagatagaggggagagtgatggcaccatccaggataatgaactgcttagttaagatggatccgtctccactcctgatccacttctcgataccgcgcttagtggggctcacacatcgaggctgattggtggcaaatttaatgccctgaaagacagagctccgtcttcagctggtggctgagtaattggtggatttgcttctctaaggaatggtgttgagttgtacccaaaaggaaggtgggaaggtggcctctgcttctggcctcccaggttcaggctcagttagcatctgatacggggttagttggagcaggaagacccccaaaatcaagctcccttctcattttacagatgaggaaactgaggcccaggaagagggaaaacttgcctgaggtcccagcgctgggtggcagtgttgctgagaccagaactcacctctcctctgctcttcaccgctgtgctcctggcttcccccacccatgcctgctcagctgtgcctcctcattcccaggggctccataggagggatgaaccccgaagtgcttccattcagaaacctctccaggagggtccccagcagaagccttcttgagcctcctctctagttttatgtcctctgcctcgggggaggatctcactttgtgggtctcctgactttgaccccagcctggatgagatgtctggctgagctagtcatctctgaatcttctcttctctccagtcagcttccagatgccagtctctgttctttcaacctctaccttggagctgtctttcctagactggagagtggaatgctggagggagtgcaggcaagggaagggggttggcgggaagcatggtgccacctcgccctgatccaggatgtcctgtttgggtagagcttgtgttgaatgaagccctggaccatgctttaccactttggaccctgtgattattcctgcatccacattacacatggggaaactgagtcccatggcagtcccataacttgcccaggtcgctactgaatgctagagtgagaaactcgattctatcgacagacttcaaattctggggaggtacatgggtggagaagagccaggaaggatggggaggagattttcaggaaaagaatccgtgcagggtatgtggaagatgatggaattttgtgagatcagggctgggggaatattaattggacctagaggagaacttttcctgtgtttttctcttggaaacagctcccttgctatatgaacccttgccatctcctctcctgtgtgtgtctgtgtctcagaggtgttttctcacctgtgatccaggtgttgattggtgctgtcatagccttgcctggcacatctgttggaaaatcaccttgctttccaccttctccctcctcaccccagccagagagcccacctccagacctgagacttagaccccacacatcacctgatgtttgtcctggccttggataagaagggtggagcccacagctcattgccaggctctgacctcaagccctgaggcagtagggtctcccctctgcccaccatctctcacgtgagcctggccccaaccccaggtctctctgtttatggttcctatcattcagtgtgtaattctgggtcagtcctttccccactcacctggcccagctcctgcactggcttccctgccctgtctgagagccaggcagctggtgaagactcagtggcaatcgatggagctgcaaactgggggataccacccagaattcccaagagaccccatcaagtagtatgttctgctccagccagtagcaagaagtggtagaaagaagttggctttggagccagatagctctgggttcagatcccagcttggctgctctgtccatgaggcatggaatgaggtgctccatagctctgaacagtagctcgttcctgtctgtgacagaggcatatttacaggagggtacgaggacccaaactgcctgtgcccatgaacgctcagaatgcatcgcttattgtattcatattttaatactctactgatattaatggaattcatattccagaaggagaggcagatgtgcaaacagacaattgcactccagtgtgacatactcatggtcgtggcatcgtacaaggcactggttgctgcctgagctgctgaaaaaatgggagtgagagtgctgggaaaactaagtgacacatgctcaggcaaggagttttagtccttagagctaaacctgtctctgcagcctggaaaccccactccctcagcttcctgcggggatgagaaggggagtgcccagctacgagcatttctcctcctggctgctaccatgactccaagtagggccatccctggaatggaagacacagtcactcctgcctcggtttacagtggtgtttcccgacatttgttttcaaggactccagcagggctgagactagggtgaagctagccaggtgcacagggggtaacattcaaagaggcacccactcactctcaggatggtgcaatgagacggtgtcctttaattttgcactgcaggccccttgcttgtctcactgtattcgctcccattcctggctcaggttctacaagatgctctgaaaaagatgggctccagagtgtaaaatatgaagaaaaatttcccactctggcccaaacttggagggtcacaaggcactgtgagcacacactccagcttcagggcctttgcgcttgacatgtcttctgcctggaatgctctctcctcaatacccctatggctcacaccttcctttattccagcctcctcagaagggcctcccagggcccctctggctaaagaagcccctcccccattgccttctatcacttcactctgctttgcttttcctcattatgtttatcaccactggacatattttccatcatttatttgattatgggctcttctgctaaactggcagctccatgaggacagggacgtgtctattgttactgatatgtccccattgcctacaacggtgcctggtacggaatagattctcaattaatttgtttttcatgcataaaggaaagacaggaagaaggaaggagagaaagttaagagaagtcctgaagggaagaacgggtttaattatacttaacccaatatctcttaaaattcatggatgttggaaatcatgttttcctgccagacatggtggctcatgcctgtaattctagcactttgggaggcccaggcgggtggatcacttgaggtcaggagtttgagatcaccctggccgacatggtgaaaccccatctctactaaaaatacaaaaattagctgggtatggtggcaagcacctgtaatcccagctactcaggaggctgaggcaggagaattgcctgaacccggtaggtggaggctgcagtgagccaagatcacaccactgcactccagcctggatgacagagtgagactctgtatctctctctctctctctctctctcacacacacacacacacacacacacacacacacacacacacacaaagaaatcatgtttcctgaaacactggtgagaagatccctattctctgcacactctgggaaaagctgtcttgtcttaacctgtcagagccaccccactcctgcacacacttcctgattcacctctaagactgagtgcgtatgcagtgggctctctgatctcaccctggcatgcctctgtgaattctactgccccagacatctgctgcgcctgccagtgctcctaacactaccacccaatcaccagagctgcaaccactcccctacttgccctccccgccaccgccacacttacacttgcaattccctcatggcttgccaacaaatggtgaccctccatcctgccctgcctgcctcacaggcacacaccatctgcacccacctcgggctgctcaaagatttatgcatctgagaatatgtccttccctcctctttccagtgggaggaggaccttcatgagccttgatctcatcagccatctggactgatgaggctcaactcataactatatctgcaaaggtgagagagagcccaggggagggcagcctcactggaagattgagccacgtggctcagaattgtggccatggggtcaggtcctcaactcctatcacagttcctgccacaatgcccatcctccatctttagggctggaagaaaaaagtatgcaggctgcagatgtacagtgtttgccactttctctcacctcttccgagaggctgtaatagcgtggtggttgtcatggagcccgaaggtttgggtttgaattccagctctgtaacttgcagctgtgtgatctggcaggggacttcacctcttggttcactcacagaaagtgggaatcataatagttcctctctcctaggagtgtcctggtgattaagtgagtagatgcatatcatatcaagtgcttagcccagtgcctggcacaaagcaggtgtgcacatgtgagccagtatcacaatgttacactcaggcttggcttgcccggaggtctccctttccgtggggtctgtcctcctgaaggtggcctccttgtttgtcatgccccatggctgggatcatccaggctggatcagattccctctgtgcccacccacaggcccccgtccgcctacctagaggctggctggtcacctgagtggtgactgtgttgggcatctctgtctcaccctcactgcttgttcctggagggccgagcaatgcctgggtctctgcttcccagatcctggccccaggcccgcacagggtaggtgggagtgaactggggttgagtaaatgaggaaaggaggatccgggttggtccttctgatcttggaagttggaccggttggttgtggttgtggctttgtcagaccaagtgggctccagggctatccaggggcttgacctctggcctaagttacaggcctccctggagtgagctccttgccttgcccctcaccctggaggctgggtcctgaagccttggaccgtgcaggtccgctctgactccaacttccaaattgatcctctccaggtcgattcttgttttgttttgttttttgttttcctggagtgttgtaaccattgagttccaggcaggggtcaggcccatgggctccatctattcagcttgcctgcacaattgaaatcttcgaacccatcctggctagttttctcattaagactatcggactggattgatccattagatcaatgactggacatcagccggcaggaagccgatcagatgagcctggatgatcagcccaggaatgaggttcccctcggaactgcggtgaaggtccaggcctctgggatggggctagtggaggcagaggagtgggttagaggcctcaccagactagactttggtgtggagagagcagtgtccccaaggtgtggctaccagggcaagagtcccagcgtctgctccaggcactcccaggggcagctggtagtagtccgggaagcatcacctggtgtttgcaatgagttcagactcctccccagatagtgggtctataatggacttctctaacatatcaccactgccatggccaaggcttggacccgaccctccctttaggtggcaaagtatgtgtggtgggaaagccaatggagggtgttaaggaagccaatggtggtttcccagggctctctttttaccaggagtcatttgtttatgaggttggaaatggaggagtatgggcacttagaacaccatgtcccagtgtgtatttctcagatcctggctgcgtaggatggtggtggggcttaaggggtggctgagcgacccatattcaaataggtttggaaatgccaagtaaatacatttcggcattcatttcctgcaggaccgaatagatgaatcatgaatgccacaactctaaaaaggggtggaggggcgatgttggggcacagaagccttctctggggtatcttatagaaatacattgaggctgttcttggaggtgccagcaggtcctaccttcagggaaaaatgtgtcccaagcagaagtgtttttggtttggagggatccattggagccagggaggcagccaaaaaggagatgttgaagagagggaagaagagggtgattggctccatttgggcctgcagtcaccattcacagaaaccacagtgtgaacagcgtccctcaaagttgtgcaactacagaccccaaacttccctcctctgtctgctgtctccctggccctgccctcatcagcccagcccctctgatctgctcgtgcccttaccacccctttctcctctcttctgtaggctacctgacagtcaacattgagcctctcccccctgtggtggctggagacgccgtgactttgaagtgtaacttcaagacagatgggcgcatgcgggagatcgtgtggtaccgggtaagtcactactactgcccccttcatgcccatggccaggactggtgtgaggtcctcagagccctctggacaccctcactggtgtggctatgacctcagccctgacccagtcctgagttgtcctgggcatctgctgggtccccgccctctgctgacaccctccttgggtactagccatcccttctaccctcaggactgatctggtttccaccttctttgtgctcctattatgcccctacgcttggaaaactccattaggcaaagtagaagttactgagaacaccctggaccctgggcacagtgtaatcacaagtgatatctgatggtggaattttgagcatgaggcttcggataatgtttttggcaagggagagagaaaaacaggaaggcttcctgccttttgcaaaatcaaatcacagagatagtctgccacctaatctgactacgtataggactaatcctggtgtctggcaccatctgagaagggaattggttagagatgagaaggtacccacctgcccagggcccaggtgttggcaccaggaagaacagcttggaatcttgagcacaaggggccttttcaaccactgagtgaaatcttcttgtgtctggatggggcatcccagtcttctatccctttgccacaaaggaattggggctgggctcagaaggtccagggggcagtgatgcttttcttccaatgcatgcttgagtgtgcacagataaaggcaccaccatcctgggggagaactcctcttctgtcatctaaacaggggttggcaacattttttggtgacgactgagattgtaaatattctcctgtctgccaaacattcagtcttggtcacagttactcaactctgctggtatggcatcaaaacagccacagacagtgtgtaaatgaaagggcatggctgtgtgtcaatgaaactttactcatgggcaccaaagtctgaattttgtacaaggttcatgtgtcataatttcttcttctttttattttttttcaatgattaaaaaaggtaaaaactgttcttagctcgctggctgtacagaacaggctatagaatgacttggttcatgggctatagtttgcaaatccctgatcagaaaccacgctttcctaatctttgttgccctttcttcaaatgaaacggatggatagcacagttaggtggagctgttctggaggaagtgatggagcatggaagagagggcaaggaaggtggggggtgggcaccaaactgtgattcaagatctagagctggctcctctgctccttggagctgtcaccacatctacacacagagcatggaaactcagtgttagaggaatccctggggcatgcgtgctgttcatagtcttgactcagaacagctctcttcagtctccttcttgctcttggtccaggtgagctttgaaccagcctgtcttggctgctctgctttgcattttcggtctctgattcatggtttgcttgttgttgctattttgttggctgtgatctgcactccttctaaccaaaaatcatagttctctatttcagcattgcagtctctcctgtttagagttaattctagtgccctccacccaagctcttcaggtagcctgggcttcacaggtgtgaacctgacatccagcaccctagagggtcccagccttaaggaagggtgccatcctggatagatcagtgggcctagagaaagtcaaggcatatgttaaatagtgccatgaactgaatcactaagaggtgtatttacaggatatgggaactgcttggctgacacaggctgggagcatctcattagcacctggcagaaggacagggataaattaactccagctcactgctgatgatgggaccacatctctccctcagccatcccatagatgggatcagagggaggggtggtgaaagacagatagaaatatggagacccagtgggaacagttaatggagcgaaatggaaggaagtttggagatgggaaaatagcagtgggcacctcattgccttccaagctcttgaagcaactgtcctccctccggtttgaaatcgaatgttaccatagtcacagtggtgaaaatctccctgcagaggctcctgctggagttatgggcaatgctagtgccaggctgtgcccaggtgtagaagccaggagcaggtttccacatggcttgacttgatgttcttgaagatggtgagcaggactggggcaggaggatccatgtcctgggctggacagagactctcctttttcttcgccatcctccggtagggagaccctcctctctcccccactcttgctgcctaaccttgatgccactggtagttttaagaatcagtggcatctcttaccattgtcaggcgctgcatatcgggccatggtaggctgcactaattaatttattttatttcatttcacatcctttgactgagggcctctggagcaggcatatgcagatgtatgcaaatcacatgcaaatcacccactagagccaaatgcctgggcccttgtaattctgtagctggacggaggtggtggctcagctgactggttactgtcctcaggtctcagggagcccacgtgcccgcctatgatgggaaggatgggggcagaggaaggaaggaaattccagggaagggctccgtgtggccagtttttgctttctgccactctagctttctctagtgattgtctctcttcccaaagaggcagctgaagggagagagataagagcctaccaagatgggggctccaggagtcaaggtcagggcagggcttccagagggaatgggagcagcagcaacaggagctccagtctccttctccagccagaccctcctctgaccccttcctcccctgccagacgaaccccccactgtggcttccttccccatctccctctccccgcagcctgcccccctcctccaagcagggagctgccgagtgctgtttgttttctgtacgtgtgtttgcttcccgtcccagcttcctttctccatcctccgtgaatgagcttacagagcccggcttggaaggaaatgaatagattacacaggcccagtcaggactgtggctccaaccccgttagaaggaagaagcagggcattgtgatgaggccgccactgcctgctcagcacagtgggcacaaaatggcccaaaacatgtgtcaagcccagcagcctcccctctggtcctaaatacattatcttagcaaagggatcatcctgagctgtcagaaaacatcatgaatgcattggattctttgggtaaatcagggcagctgatgaaattatctgaagccatagggatcacctaaccttggagctaacaaaacctctggctggatatttgggaaggtcttgcttgtggacccctcaagggaggggaaggaaattgggaggaagcggcaagagcctgactcttggacactttacccccatggtctggccaagtggggaggagctcagcccgtttgtagaataagatgccaaaactatgagaatagactcaaggaagtatgtgtaatcatagccccttggtctgggttgtccaatatggtagccaccagtcacacgtggatgttaacatttaaattaaatcaaattaattttaaaattcatttcctcagtcagactagccacatttcaagtgctcactagccacctatagctggtggcctccatattggacagatgaagtatagcacgttcccatcactgcaggaagtttcactggataacctgctgtagaacattgagattttcttttgcagcctctggaatacactgtgctcacctgacaagagaatagcagtgagtgatcattgagtcagttttccaggcaaacttgccctgaaatgaattttagtaagatggatctcatttggtaacctgacatcattagatcgtgtgtgtgtgtgtgtgtgtgtgtgtgtgtgtgtgtgtggtgagggagggtgaaaaaagggagatggtcatcatgctcaaatcacttctttgaaaacataaagatgtcaagagagttgtcatccctctaaggtgctgagtatcgtagttgtctattaaagccctgtccaacttgaggatgcttttcaccatccccctctgctttctccactgttacatgggttcatctcccagatttgagtgtccaggcttcatcttcacagctcatatagataagctccagacagcttttttttggctaatagagtaggggtgcaattccatatttcaccagtaggaggctgtcagctaataactaatctaccctagcacttaagttgggacttggttcaagaaaatgaataataaataatgttctttacttaatcattcctatttacatctgtaactggggacttatttattaatgctgcttatactaatttgagtggctgacattattgagcctttactatgtgtgagcactagatcaagtgctttacatacgtgatgacatttcattttcatattttcactgaaaggtagatactatgattaattctattttccagatgaagaaactgaggccattcgaagagactgtgtctcgggtcatgttgccttccctgacttctccagaaagctgtaggcacaccctcctccatgaatcctctgtgtgggtctttacactagtgcttacctcatcatgtcaaaatacctgcccctggaccatgactatctgaagagcaaagactgtcttttctcctgctgtattcttgacacctagagcagagtcacctcagtgaacatttgctaaattaacaaatcatggagctataatgtgcacctgttgacagaccatgctatgtagcccacttctgtctcatgtgggcatctgtgtaatgttgatagtatctgttggtcagggggtggggagtgtgggtctttggatactcagggggctttgttaagtatgaaggaaaagggaacatttcttattaggaaacactgtctgaactcatttggttggaggccgcctgcccagcaggcaaagccgaaggtctgtttatatcatggaactccattaaacagccacagagaatcatgggagtttaaccttttacagcagtttttatcatccctcctttgttttctctccttcttttacaatttgttcccaggagccactctgggcccaggttacaaggccacagaaaagagagccagatagagagagaaggagatctacaaacagtgataacatccctgctttcagtacccctttatctcacctttttcaccatgtgggaagatgcatacctgggtgtgtgttttgtggtgcagatgatgcgacctcgccaggtgatcgtcccctctgggttctgctggatgcctctgcaatgagggtttgtggttgcttgggaccatttgaaaaggaattgagactagaggctgggaaggctgaggtaggaagagagaggacttgagcatcagaatacctgtgtgtgagtttgaccttgggtggtgacctaacctttcagccttttagaaacttcacctgaaattgggcatgaaaacatgtattttgtaagcttaaatgagataatgtctgcaaccaaaagaccccattgttcagctcattgtggcacctattcaatgatagctattgtcatttcatgtctgttgatagcttacaggatctagagagggaaattatagaataagaggggaaggtatttggggaggatcaccacggttagattccttgaattccatcctaccacctgcattcccaagggatatgggcagagacaacgctttaaatggttatgctggtgaactcactgggtttcaattcttggaaacccagtggcttaacacagttaagccatttcaatggattttagctctccctgaaacagggagctatttcaaaatggctttactatcattggctctctctcagtcccagcccttcacaatgtttcattatttgaagcaaaactgaaaatgatgatcctaaggagacaggaaacaatacagtccaaccatatcataagggcaagaaggtaggtacactctcgggtgaccaagagagaccagcaccaaggtcccagaggatgggtctagacaacccctttggcccttcttgcttggcagccactcatcctggctgctctttgctactcctctgaccccacattctgatcttgagttcagatcttacagatataagtctggaaaaggatgtgagtgaggaagacaaaagccagggttgagccaacccaacttgccttgtctaggcctccttccccaacccctggccttccaaagagccaggttctccctgatgaggtatgtccagtgctcagtcttatcatatcagtcacatgggaaggaagagaaggcagccagagagggcccaccaaacaatagttgattttacaacaaatgtaataacacataaacaggaaataagaacaagttcccaggtctacttccattgtaatctgtattcgtctgttcttatgctgctataaagaactgcttaatactgggtaatttataaaggaaagaggtttaattaactcacaattctgcagggctggggaggcctcaggaaacttacaatcatggtggaaggggaagcgaacacgtccttcttcacatggtggcagggagaagtgccagcaggggaaatgccaggtgcttataaaaccatcatgtcttgtgagaactcactatcatgagaacagcatggggaaaaccatctccatgatccaatcacctcccaccgagtccctttcacgaacttgggaaccacagttcaagacgagatttgggtgggggcacagccaaaccatatcacaatcctttaattcaaccccaaggaaaactccacccctaaccacagctgttaagttgtaaccatccagactcatcacactgagctcctcctcctggggatggggtgatgggagaaaccttcagctccctctagaggccagagtgtgaatcacaatcattgcagccctgatccttgatctttaatggaagttctattggaaaccggcaggggtacctgactctgacagctcattagacttctcagaggccactaaaaatacactgttgtctgagactcattctacagttattgaatctgaatttccaggactggagcctcagggcatttgtacttttaacgagttccccagatgacagtgacgcactcaacccagccacggagcatgtcatggcgtttgtgaaactctgatagagggagctgttccatgcactcatccaacattaattcaacacatatttatgaaaccaggatggttctaggcactgggatttcatcaaggaagaagacaagatcctgtgctcacacagtttaccatgggggaggagttaaaaagataaacaaataaggaagataccagctaatgataagcgcagtgcatataattaaaatcgagtggtgggatagaaagagattgtgtggtcaggaaaagacatttaagctgagatcgcaaaggcaacaggaaacctaccatgccaagggaagaaggcagaataatccaggcagaggggaaagcaaatgcaagacagttctgtgggaaaaagctttgtgtgttcaaataacagaaagtgcatgtggctggaacaaaacgaatagggggtgatgttggaaaaatgggcagagaccgttcataccaggccctgtgctgtaagaaactgaatctggagttattctaagggcaccaggaagcattgagtttaagcagagaagtaacagggtctggtttactttattaaaaaggtcacttctgggtggagaatggtttgcagaggaggtgagaaactggcagcagaggggtcacttggaggttagaatagttcaggcaagaggcaacagtggtttggttgactaccaggatggtggtagtggagatgatggaagggaaaaatgttctgcttatgatttgcaggtagaagttaagggcttgctaacatgtggaagggatgagagaaggggggattcaggatgactccctgctttggggcttcggctgggtttgcaggagcagtgctatttaatgagacagggaggacaggacaggagaagcaggttgcaaggtgatatggtttggctatgtccccacccaaatctcagtttgaattgtaataatttccatgtgtcaagggtggggccaggtggagataattgaatcatgggggcagcttcccccatactgttctcctggtagtgaataagtctcatgagatctgatggttttataaatgggagttcccctgcacaagatcctcttgcctgccaccatgtaagatgtgactttgattctcatttgccttccaccatgactgtgaggcctcctcagccatgtggaactgtgagttcattaaactgtccttttataaattacccagtcccaggtttgtctttattagcagtgtaagaacagactattacacagggacaggcgtcaagcactctctgttggctatgttaagctgggagtgcctctaagacatggagatggagctgctgcagccgctattgaggccacaaatctggaatgttggggagaggtgaagcctggagacttatacttggcattgtcagagaatggatggtacccagtgctagacccttgggcactccaatatttagagatagaaaagtagaccaacagagaggctgagaaggaggaggaacagccagcaagatgtgaagacggtgaggagtggagtgtcctggattccaagaaaagaaagtggtttcagaaatagtagagtcagctgtcagctagctgtgtctcacactccagtgagtgacttgagagcagagaaatgaccatgaacttggtaacatatggagcccactggggacctgggcaagggcagattccttggaggtcgtgggggctaatgcctagctagagtgggctgaggggtgcattgagatcagcagtaacatggccttgagattttgtctagtaaagagttttgagcttgaacatctgaacaaacctttgcaagtaacatgaagacccaattgcttctattgaatccactcctatttgcatgtcattcataaaattacaagcccactgtcttttcctaccatccttagcctttcaatctgggactggtggcagcctcgctctcctcatcgagaatgtgaaagtggcagccgagagcgtttaggggattctagtgtaattaaaaaatgcatttggtatttgaaagaaaaatcctgctctaccatttaattaactcagtggccttggatgacaactattcccaaaacttcctaggcactgtacacaggtctgaaggtataaagaaggacaggtgggcccactcccctcgaggggagcgcttcccgtccagttgcccatcatcaagttgttaagttctgtttcatcacctggccaatgggcttgactgcactttccctaaggatctcacaaagatttgtgcaaaacagacgaaaagccccacagacgagctgcttctgtcccccgtggcgcaggggaaataggcttcacatatattacttcatcttctcttttccgcctgggcaaatcttactcattctctcctctgtgaagccttctgacccctctcaccaaagcagaattaagagatcacctgctgtgttctctcagcgttttgtacattcttcaattagagagacagcacctggtagcttagttattcatctttgcatctcttgcggagttttatttttccgcttctcctatgtgtcattcataaaattacaagtccattgtctttagcctttcaatctggaactggtagcagccttgcactcctccttgaaaatgtgaaagtggcttcccagagagtttaggggattccaatgtaattaaacaatatatttggtatttgaaagaaagatcccgctctagcccttcatttatgaatgatccttgggccagggattctatgtgggggcctcagggtccctaggaaatatgtggatgggcttctgggggtgctcaaaccccagaaaatatgcctaatatgttgtgtgtgtttttgtgggagaaaggtgcagaatattctcaaaggactctgtgatgcccccatgccccaactgaaaaacccaggaaatgcaacagcaggcatgcaggtgttcgctgagtgtgaaatgtgtagggcatctcattatctccactcttgggtcatcaaggtccatatttaggttggctctaccagaccctgtagctgcgaggttgtgccagatggcccatgagtggtccacgagcttccaaggagtgcagtggggaatgggggtgagaggtgaggcagtcaaccttaggcaggaagagctgctgtgtgattgggatccgtccagacaccacagctcagtcagcctggatttgtgcacagatgcccttggacgggaagaggagataagaagcagggtggtgggggaagactggctttggccacacatcactgttctccctggcttgaaggggagcggtttttgaccaagcaaatccatcttctcttggggattaagatcagtttctgataatggcaaggagaccacttccctggtccacatggggttgataagagctcttggcttccaaactcttgagagggggtgccaacagctgaagtggacacccaaataaccaggtgttttgttagaccacatgcagagtccaccagtgatgggctcccacactgcatgggtgagaaagacacggcatatctaaggataacacactgatggctcagctcacttcacttaccaagaaaagaaaagagcaagggcctgggacacaccatcctgctgtgtgatcttgaaaaaaccacaacccctctctgagctccaggatcttcataggtaaaataaaagcgtgcagtgagatggtctctaaggaatatgcagcctctctcccaccttgcggtcaacctccccaccccgctatcttttccccagaagactcagagctaatggaagaggtgggtgcctcccaggtcagggcaccccccagctgaggcttgaacaatgctttctcaggggtgagagtcctggcctgagctactactgttggggcctccgagcacatggaatccggaagtatattaagcccaaagtgtgatttccagcagattcttcctggctttcctatgccctgttgggtttaaatgacaaaggggctgacttaacttgtcggaaaaggattaaaggtgaacttcagctccagcacaccagtgaaaagaaaagaacatgactgaaatgagggatgtttcccagctcagactcaccatccctcctaaatcctttctcccctcctctccccacattttccttgttgggtgtgagctcccacagggcaggcagtcttcccgttgcagacaggcacagccgtgtgcttttctaaaacacatatctgaccttaccacgaccacccctccctgccccacacttcgcaagagcttctcatcacctgaaagaccaagttcaaggtcattggcccagcatacaaggttcttcttgattcaacctctgttgactgatttcttcagccttgcttcctaccacgttcccaaatgggcccaccattcgaatcatatggctgatttgcagttctcagaatgtgccaacgttctttcccacctccgagctggtgcatatgtgctgtctctgcgtgcaatgcccttctcccctccatctggtcaactcctacttgccctccaaggcccagcttcagtgttgccccccctccccgccaccagaggcttttccccatccatttttcccccttcaatcttcttccacattcaactgccatgacccaggctgagttagcttctcataacactctcaaaatactaagcacgtgaccatatgactcaacacactggactcatgtgttcatttttgcagcagatatttcttgagtaccaactagtgccaagccttgggaatagagcacagaataagaacaatgggctgggcacacacaggctgtggctcatgcctgtaatcccagcactttggaaagctgagaaggatagatcgcttgaccccagaagttcaagaacatcctgggcaacctgacaaaaccccatctctataaaaacacagaaaaattaaccaggcatggtggtgcttacacctgtagtcccagctactcaagaggctgaggtgggaggatggattgagcccaggaggtcaaagctgcagtgagctgtgattgcaccgctgcactccagcctggaggacagaaagagaccctgtctcaaaaacaaaaacaaagaaacccaaaacaaatacgcaaaacaaggtagccctgtcttttgtggagcttgtagttaagcgggaggaaacaggtattacatgaaagactgtcaaataaatgcttctttcaaattgtggtcaccgctttgacagagaaagacaggtgtctgcttgctgagagctcatagtaggagatgaactgtaatagttgaatgtctctctcccagaatgcaaaccctttgctggcagtgaccaggtgtcctgtttgtctttctctcctgagtgtctagcatgatgctgagcacatagcttagaggatggatggttggatggatggatagatgtatgcatggatggatatcttatgtggccctgagggtcacagaggtaaacttgtagttgatgaggttaataactttcccacagttggagcttttcaaccatggatgggctgtcttaaggactggtggacttcctaaccctggaaatgtctaagcaaatggcatggccacctgtcaaaactgcagtaggaagtaatcctgggcccagtgcacccagagctattgaccctatttgtttcagctctggaattctgtgctgcctcaagctcagctgcgcagccatgatatcatgacaaggggtaagaagcagagtgtccagccaacctggctagttggggttgagtatggggcttctgtggaaatcaggcatcagaaagttccagattccccaggagtagggttatgtgactgttctgagaagcagacatgtgtggctgtaaatgtccagagaaagtgccccacccttgagtgaacattcaaaggtgaggccaggggacacctgggagttgagaggagggggaggatgtgaacgaattttatagggttcagaagtccactccacaacttatggccttatacaaagcatctctgtccatgccacactgctttaaacacatcagtgatgcctttccatggttcttaggatacagacaaatatccctggtgttgccatacaggactttgcattgtctggcccctgcctgcccctcgaggctcctctcccagtatgcacccataagtgaagattctggggatatcagagacctcagagagccttgagagaaggaggtagaaggactagagtcagggagactgaggttaggtgaggttaagcaacttgctcaaagtcctgctgctagatagtggttgagtcaaacttcaaaacccaactctctgactacaaagttcagctctttctgttaggtcccattgaaggccataaataccctgttaggggttggagggatttccccctgagcgatgggcagtatgaggactggaccctcgaatgcgctgaatccctctggcttggggagcctgtggcaggtaagacaagccttcctcccatctccctcatatcatcatgaatgccactgctgtagcggtgcgttcaggtcaggtgctgcgctaggtatgttacaaagatcacctcactgaatccatacaggaatcacaagatgccggtacagttgtccattttagggttggggacattgaggctcagagaagttaactaactgaccccaagtcttgcatatggtaaggcggaaggggtttgtctgagtccccttagagcagcccagccttctcactctaagctgatggagtggtctggatccccctttgggaagctctgtggcctcctccgtgggggagagatggagatggcctgggggcagaggagcttctggacatggctgcttcaggctgtcctcatcatcaccctgccggagccatctgtctgcagtagtgctgcggcacagatccacacagaggctgtcaacgtcaaatgaggacttgagggaaaacagcttccaccctgcagagatgacacaggcagcacggttcacctactctgagatgacacaggcagcatggttcacctactctcagcacggcagagcagacaggtgtaaggaagggccccttctcccccacgctgcctccctgcatgcccctcccaagctggactctcttttggtgaatggtggaaaatgtctagcaaaaccgtccacggctgaggctgcttccagtcatggcacacagacctcaggaatcccattaatgagagggatggcttctgaattggataccattcttcaagaaaggaagttgtattattattattttattattttgcaaagtggtagagtaactcaaatgagtctaaacaagtattgtcaagtagtggttcttgggggacctgctgtaatggctataatagtcatttcaattggcacattaattatatgggagcaggtgcttctaaaataattgagggtgtaagaaggctgtttatttccttacgtgctttcaacgttccccttcaaccctctttactctatgaatatcaagtcatgcaaagcctgttctttggagacagagaagtgaagcctgtctgaaatcgcaggctctaatttagggaagtctccagtttattcgttcatcccttcatccctccaggtagagaactaacacctgcagaaaaccttggcagggccttggctgcagcctagagatgccatccctggctcacactctgctgggggggacaggtgtcatgtgacccgcacccttgtctggagctattcaagagtgaggaagggacagtgggcatggcaagtagaggtgagagcaggtgcaaaggcctgggggtggcccatctgactcccatcaggcgctcagtgaagggtcaggaagaggggaggcaggaggaggaggctgagggcaatcagggacctatgccaagtctggggtgccctgcaatggagcttgagctatatccaaggggaacagtcaagaaattttaaacacaaaagcatcatcattcgattttaggaagctctggacccctccctagagatgtctgataagcatctcagacttaacatggccaaagcaaagctctgcatttcttccctaaacctacccctcccttagtcttctccacctcagcgaacggcatcaccatccaccagtttccgaagcgaaaaatctagggcgtctctcctatcacatctcatcccttgcccctgcccactccccgcatctcttccatcgaatccgttctaaaagacaagccctgaatccactgcttcttccccattcctgggcctccaagccagctgaagcctctatcactacttcaagtcagcaccctcctgatcacactctctgcttccactcttgtcccctcagcccccaaatccagtatccaccaagcagccagagtgaccttttgaaatcagaacagtcttatcattcctcagttttgcctgatacttaacaataaaacccgggaggcaccacccggtctggcactgcccctttctggcctcgcccactccactacctcccaccacaccagcctcatttgggttctgtaaacaggagccagcccacacctccagatccacgatgtgcaggcccttgtgttgggtgctgctgggatttcaaagatgagcagcatgaaccctgaggagcgagcatatggaccagcagtgaagatgctgctttgccaaggtgcctctagagacagaaagatccaagagcaactcctgcctccacctcttcctctgtcacctcccccattctccatatctgtgtctataaaatgggatggtgataatagcactgacctcgtggagggccatgacagcaaccatgcaaccaagcatgcctggaacagtccagatggcgcttgttatctgagggtgactgttaagagcaacccttgttcagcctcaaaagtgcctgatttggacgacaaatgacacttttgccaatgcagcattctggaagcgctttgcaaatgtcgtttctcaggatggtgctctacttctctgtgcacatagaccatgggacagattcaagggcagcgctccatgcattgcccccggtcgggagatttcttaagctacaactctgggcaatggtagaaagagggacggagccctagcctgccagatgaaaagagctgactttggaattcacctccctctccctttccagcatggaccatgggccttgatcccacctaggtgttgggctgtgatgggcaggacaggaatcacggtttaaggggttgttgcaggtgatgctgggtgggcctttctctgtgtctgaaagctcgtgaaggaaaggcaacccagtcacccaggagtggactcaatgccggaacaatggatcccttgcacaagtccagctgcattgctgacctatgtggcctttccaaactgtgccatacgtagagcctgttgcttcatctttcagcaaatagttattgagagccctctgtgtctcaggcctggtgctggatgctgccacagaggcccctgccctggtggaataaaggaaactggtaattgcacattgatcttctatgcagacatcttactgacacttatcagtgctaatagattttttttattttgatcttttgcattatgatgtgaaaatattatctgcaaataataataataataatacttctcctctcaatgcctgagagacagcatttttaaggtagaaaaatgtatatcctggaaccagatcacttggattcaaattccagcattgccacttagaagctgtgtgacttttaacaagttacttaacctctctgtgctccagtttcctcatctcatgtaatgaacttaggacagtgcctgacgctatataaatattggtagggctatacttattgaactgattataatttcttgccttattccattgtctaaaatttccagaatgcttgtaaaaaagggtttccctgtcttattcctagttttcataggaatgcatttataattttaacattgcatatgatacttcctgctggcttctgataaatattcttttttgttatgaataggaaggttacttctattccaatttcacctagaatttttataaagaaaaattaattaaatgctccttaaaaatctattgaaataatcatatggtttttctcctttaatttactaatgtaatgaattatgttgatgtttttcctaatattgagcctccattgggtttttgtaatttctttaaacaaatagcttgtgtagcaaattaaaagagctctcaagtatttgtttttttattattataaatgggatctttttcattggattttctgtgggtctctgggatgtaagaatgcaattgattttttgtggctttatcttgcatcctacaaattagatgaattcattttttttctctttaataagcatgtagtgctttctctgagttgtctaggcatccagtctccccagctgatatttttgtttccttctttcctgtatttttagatctattgcatttagcaatgagcaagcatgtgttgagtgcctactatgtgccaggcactgggctaggatctgtttcctctgctgctgttgctgctgcttggcagggtgggtggttggagtaccctcttcagctggaatattgagagcaggggccttatgagggaatgaatcccaggaggtcccaaaccacttagagtcagatcaggattcaaacacattaaccctcaggtcaggctgcctcctgaccgatgactctccccttcaaggggcaggggtaattaaccttgacaaagaaggggaaaccaaagcttgggaatgcagcagtcatttctggcctggaggtgaagatagatgcccttaccctgcaacctggccttgaatggtccagctctctgaccttctttttgttcttgcatctgggacttgctgctattaaacaggagtgaaagtcccagttatattttgtttctcttgagcagcatcccagctctggggggtgtgagatggcatggcagcatgctgccatcccaggccctccctgagtctgtgaatgaggccctcttgcttcctgggtgaatgtcactaagaggctgatggcatctcagtgcccagtgggcccccctcactgcctggcatgactcttgctgcctcaggtcccaccccttcctgcctatagatttgcccttggtttttgagctaattactccgtctcatcactgcactgactcttcccagcatctgacagccctatgagcgtgtatcttgtaatctcccttcacctaacacaagtcagcttaattatgcatgtggagcttaggactccaacctccaggctcatactctgcaattatttctgtggtcttgtcccctctggcttcctgcaaagatggcagctggtgtcttgctgtggagtccctggagttacaccctacacggggtgcctgactgagaaggcagagggagctagctcggtatgtgctgtaatctccaaactccatgcttgggacatcttttattaattcacactaaattgcagtgtggtttgtggcaacctgtctagcgcaccctggcggcaccaaagagctgccctgtccacaccaacaacaggcttgggagcctcccaggatcccgggaagtcctcaggctctgcaccctgccccaggctcttggcagactctgtgaagctcaacacatctgagtttggaagctgctttggactcagggagaagagagcgaatctttgttggttattgatgctgagccaggcactaagctaagagctctccatgcaccaccggaaggaggaactacaagtagctccattgtatagacaagaaaactgaggcgcagagacgtgatgtgaattcccaaaagttgcagagctggaattcttttttttttttttttttttgagacagagtcttgctctgtcgcccaggctggagtgcagtggcacgatctctgcacagctggactttgaacccagtgcttctaactccagactgccactctacccgttttcttgttcccttgagatggtcaggggatgtgaaccttccacttcacaggggctgccagccttggtgaccccaggatgggggccagctctgtcaggcttctggaggcaagactgggtgcctggactgtgctggggattgaaggagcaggtacatccccttcctcccctgggccatcaactccttcatccgcctgggacctgctgccagcctcatccaccacgtgtctttgttgccctgggtggtggcagggaatgagggtgccatcctttgagtgtgagcttctggagctcttacactcaaagcatcagaggtgaaagtggcaggagagtgcccagccaggaaccatgggccaggaagcagcccatcctcggaggtggcaggtcactggcctgtcaaagcctccattcccttatctgcaaaatgagagaagtaacgcccctggatggggtatcgcagggagaaaatgacatcactctggcaagggctggcaaataatatcaataccaataacaagctactgtttattgagcactgactatagaccaaatgctgtctaaacacttacatatatcagcttatttaatccccatagcaaccctaggggtgggtactgtcattgtccccattctatagatgaggagacagagacacagaaaggcaatcatttgctcaagatcccacaggatttgaagtgggattcaaactctggtggtttggcttcagcatctacactctcatttagtaccttctttaaaatgttagttcctcccccaaactccagccccacacacacgcagtctgcccaggcaaatagagccattagctataggtgtgagcactccagttaaaaattccagggattaaagcatctacactggcaaggatagaagtgtctacactgcaaggaggatttttcctctagtgctggagagaaatgtgcacgtaacaccaccaaaggagatgcaaccaggttattggggttataaatgtcccctaagctgagcttctgcctctacttcccttttgtttcttcaacactccccacaagaggctgtgtacacagtgggagcctggctgatgctggctaactggactctgaagggagacactgcaacgcatttcgagctgccagaattaacccctctgtacatctcaaaactttgcacagcatagcgggggctttgggcagcctgtcggaggttgatttctgtgatctggtgaaattctgtggcgtgattgatagattgcctttgtagaaaagtgatgctgggattttccattagaacagggaggctcgctgttgtggctttctagaaggtcagagggtaggagctgggaaaatgctacccaagcagacagacagtctccttcttggggccttgagagattcattcaatgtgttcacttcatgcctgccgtggtgcttaagacacagatattgataagataatatctgacaagtccacatggcgagttctccggtgcaaggtgctctgggtgaaaatccttcattcctccaacattcccacaccattcctttacttaacaaatagttaccgggcccctacaggggtgtcaggccctgtgctagttgctgagactaaatatagcgttgaacgagataggcaagttctctctacacccaaggagcttacatcctgttgggatgcagagcaggtaggcctgacctgcttggtaagtgatggaggggtacatagcatggacccccccaagccagactcgagtggtcaaggttggcttcgcaggggaagaaaagtatacactaaggtttgaagaatgagtagaacctagctgggagcctgcgcaggcctcctaaaatgagagaaagtgtggcacccccgcccaaattaaactggatcatgcgtttggaggccagacagggaggaggaaaggaatggatagcagccagagaggtgggcaggacccagatcaggtattcaccttggtgagatgcttgaaccttacctggagaacaaaggggagccattcttcttaagcagaggagcagcatggtcttatctgcttgctagctgtgaggtccttgaactgggattaggggagggtgggaggtgtaaggacagggcaagggctccaggttgagggcagctgcagccattcaggtgaaagtgatggcagcccgagttaggggatcagcagttgggggtggatcatgggcaataggtgggtggccaggtgcctgctagacacaccgcacagtgaacagatggctgagtgagaacgtggaggctgcttcaccagatgcagaaggtgagggagagggaaaggtggtgtgggaaggggcagctgtacgtgcaaaagcagtgtggacattgggggcagcctctctgggcttggagagctcagccggcacagttagatggccgccctgaatgaagcccaagctgttttgcccccgtggtgtctctcaccccgctgtgcctataaatctctctggttggggccagaggaatggcccagagccatgcagcaagagaagaagtttcagtttttcaaataacacctgccaacagttgctctgattctagatgctaggttttgcctccctttcctctactggcccacagttgtggatgggaaacccactggcacgggtgctggcaacagtcagactgcaccccaggccctggctctggaccaccttccctttgtgtgtcttcagcctcatttcctgctgccaggggaggcattggcaggatctgactctgctgccggctctgccatgaggcaggctgctcccctcctttccctggggagagaggtgtggacacggaggaggcagttggggccccagtgcccaacatggtctctgtgtctctgtctctctctttctcctcccctccctcctccctccccccttccatcccccactccctccctcgctccctccctccctccctccctccctccctccctctcctgctctctcttagttcaatttgtacaggcttttcagagaccccagggaattcacatgtgtattgctttgtaaatgttctgacgatgctctcaggtgccagggctgtgtcttcagcatcagtttgggagttccttcaggagcaaatgactgcatctccctcaacagactgggaacccctgaggccaagggctgaatgaagagaaattactaaagacagagtaagtgcttttgcacgtacagctgccccgtccacaccacttttccctctccctcaccttctgcatctggtgaagcagcctccatgttctcactcagccgtgtgttcactgtgcagtgtgtctaacaggcacctggccacccacccgtcacccatcgctgtctctccctctcttctttgtgctgtctcataaagagatatgtaattaaactaccttcaaacattatatggcgaaaattataaactagaaagaggatcgccaggtagttaaagccaggttgaaatctcggctctgccatttactggttttaacctctctggacctcagtttcctcttgtgctaagtggggatagtaactctaaactcacagagccataaaagttaatattcccagtctacaagcatttataaagtgcctgagtgccaggaactattctaggcaccaggatgtaatggtgaataagacaaacaagatctctgctttagtggggtgaggagacagaccattaattaattaattagcaagaaaatatcagataatgataagtgtggtgtagataatttcaggtgatgtgatagagagtaactggggcttcttagatcagctggccagaaaagatgcctctggggaagtgacattgaagctgagctctatatgacaaggagttagccaagcaaagacctgagggaagagcatgccaggcagagagggtatctatggatgggatgagcgtggtcacactgtcaagggattagactgtgttcttggaaaataggcaaaggaaaggggaacacaagtcagggcggtgacagggctttctcacattgggctttgtagatcttattcttagcataataggacttagtggagagtcttaggtggagagtgacatgatctaatttaggtttcaaaaaaaattatctggctgttgtgcatagactggactgtaggggagtgtgctagtcaggagagcctgcgttgtgccccactaacaaaataatcctcaaatctcaatggtttgttacaacaaaggtttatttcttattcacggaaagttggatatgagtctggcaaatctccagagctactctcttccatgaagtgactcagggatccaggctcattttgtcttgtagttccatcctctcaatatgcacagttaccatccaaagggggcacaaaaccaagagagtcatgtggattgctcttatgggccagtctggaggtggcttaagtcatttccactcattgtgtccatccacacggatgcaactgtgagggaggctgagaaagtgtagttttactggatgcccaggaagaggataatgaaacaagatttggggatcatacagctgtttctgctaaggacagaagtgtgtatatggaggctctcccaatcttcctgactaggagagctaagaggctctcctagtcttcctgatgagggatgatggtggcctgcatgtgagaagtggcaatgaggatgcagggaagtggacacatgtaacattcatacaacacttggtactatggctaagcagtaggcccccactacacaatagctcttattttaatatcctttataattaaaacaccttaatctttctttacaagatgaagtcatatttgccaaatgggttttctctgatttcacaaggtcaataggctggaacactttctgaccaaggcgtttttttttttttttttttttttgagatggagtctccctctgtcaccccggctggagtgcagtggtgcaatctcggctcactgcaagctccgcctcctgggtccatgccattctcctgcctcagcctcccaagtagctgggactacaggcgcctgccaccatgcccggctaattttttgtatttttagtagaaatggggtttcaccgtgttatcaggatggtctcgatctcctgacctcgcgatccacccacctcggcctcccaaagtgctgggattacagacatgagccactgcacccggcctgaccaaggcttttttaaagacatgctcataaaaccttggaatgtagtaatggcttttagagatgttcaagtcttccttctgcattttaacaggtagaaagagtgagtgcttcagaggtggccgtagctttgctccagtcacagaggcagtcgacatctaagcaggggccagggccagggcccaggtctatgtgcctgtctatgaagtcaagtgatttccggatttcttctcccccagcaagtccaagagtacaaacagctggggaagcctggggtagagtttctctcctggtcacatcagataagatctgagtggaagaggaggaagggaatcagagaggacttggtcttgcccacccaaatctgtctgctgctctttttccttcttgtgcctgagaaacaatatacgggggccgggggtacaaagatcatgggttccagcccacctctgccatttcctcactgttatatcttgagttagctacttaccctctctgaactttagacttcccttttagaaaagaaagctaatgatgccagcctcgccaggttgttatgagggctacatgagatagtgtaggtaacaaacctttagctcagagcttgatacctagaagatcctcaaccctggaagtaattaattggaagaaacgctgagcctcctctcctcaccttccccctcacacccagcaccctgggtgctgtccctgtgtcaccttgtaaaagcccttctggaattgggacaagcttaggaactcactctaccataataaatgaatgtgtccctctttccccaagcaggctgcgtttcccagcatcttcatccgatgtgcagggtctacccagccccgtgtttctctgctgtaagatacactatgcatccttggcaccttgcccagagggccagggggggcctcagcaaacccaaactttcctgagtcatctgatgggctacactgtttcctggcaccctaatgtccttaaatgaacttctgttgtttgccttgaatcaaattcactgggagcaggggagccaatgcacacccttgaggactgggccaggtcccaggatgggccacagcccatcagccttgcagaagctgcatgggccccttcgttgctccttggtcctgcccagagaacccccaggctggatcctaccagtccctgggatccagcatggctttcagaagtagctcaataaagagaatgttaaaaccttttaatgcttggcagggaatctgtcctttgccaaaacaccaattaaaggcccaggccagttcaacatgactttattactagcattttatctggaagagaagggatggggggaggtagcattttatctggaagaggaggcaatgaagcctctgggaaacaccctctctgcttcctctgacaggaacaaccccgcacagtcactgggcgcctgcttcctagaaggctccagagagaagccaaaagagagaaatgagataatggagtgaggttactcaaagaagcctttctgaaacagcagattttaagctgggctttgaaaggtggatcaagtcaggggaaagtggaaagaaagtgggggcttctcaggcaggagattctgcaggagcaaaggtgaggctgaggggctaatcctcagtgctgattggacactttcattgtctcaggaactgcgctaagcattttagacgtgatctctaatctttcaaaccaccctgggacacaggctctatgattatcaccattttgtagatgtagaagctgaggtttaggtgcttctacccagttcatgcttgtagtaagttctggagcctgaactaggcccaagcagatgatcccagtgcttctgctcttaaccccaggctgagaagtgagagatgagttggggagggctcaggcagatgtgaagtggagagagtttgtcattccttgaagtccagaggcccccatttccctctttttgagccattcactggatctagacctctatctgaatacagcgaatggctcaaaaccctaaccctaaccctaaccctaaccctaaccttatctagctccatccacacattcactggatctaggtatctttaaccctaaccctagagttagattcaaaaacataatcctaaccctaatcctaaccttatttagttctacccacccattcactggatcttgacctcctgcctgaacttgtccctgggccctggtccctcttgtcagctgtcttcatcctttctagtctagtaggtgccattgaaagccattgctcccaaaggggtatctctctgtcaggtggccttctcaggttgtggctgatggacttgaaattcctcatcaaccactaaataggctgttgcctgtgccactcctggacataggttgtccaagccaagtgtctggtggctctgttccacttctggaatcttccagaaactttgtcaatgcttatagcctataagagcatggtgattcttcagttgtttgcccattcttctatccatccatccattcatccatccatccatccatccatccatccatccctccattcatccagcacttattttgagccagtgacgttgtccttcttacactgggccctcagcactgtgggctgggactatctggagaatgaaggggttagttcacacagcctatctgccttcaggctttgtcaagggataggtgctttgaagccacaaggtgaaatacactgaccccagcgaaagtgacaaatttggccctgcccagatctggtcttccagtctccagccccttcctctgtagagatgtgcatgaagaagtgtcccagcacctggattacagagtgagaaactgaggcttggaggagggggctaagcctgcctcaagagcatggcaatctaaagccaaacttcactctgcactcccctgggtacctgctcattactcacccaccttgatgcccctgctgggcttgtgggggctttctcccatccaagcaggatggtttttgtcaagcccaatattgcccatggtcttgtgcagagagatgtgccctctgcctgttgcaatgctgtgattgggacagacatggacacatcctcacaggacacacagatgacaaaataaaggctcaaatcccttctcctgattctgccatcatgcccctaacttcctcattccctcacttctcatggccctccctttcttccacactcctcactctcatttctttggctctgttcatctctgttctaaatcattccctctttctttccctgaaactccctcttgattataccctgtgttcctctcttcctctctgcatcttacacctgctcacacacattgagagtcatcctcaaccccccttcctactgtttccccatacccaggtcatcttgctccaagtcttgtcaattccacttcctaaatctctcttcaatgtgcctgctcctcccctccctcctgaggtcccaaagtgctgttctagtccaccatcatcttagtctgaatgtctgttacctcccaacttgcccagaggtgcaggcttgtgcagccccagtccattctccacactgtagctagagggaactttcaagatgcacatctgatggtgtcatttcactgcataaacccctgcagcagcttgccattggcctcaggatggagtgcagctctgttccatgtcctacaaagcattacagaatctggcctctgcccaccctgcaccccatctttcatcagccccaacccaggccctcccacctgatgggctagccatgcaatggggcttctttctattcatcaaattagccatgccctccctgacctctgggtctttgcctgctgtatatgccctcctgtatgactagggtaattcctacccccctttaggctggaaatctttcctcaactgccaagtctgggtgagatgcttctgcactgagacgcaactgcactgcaatggttccctgtgattcctaaattacagcatttattaaagtgaattctaattgcctgtttaattgtttgctttcactgctggagccgcaagggcttagggtacaataggcttccagttccccaaggaaagcgtacagctgtctccctaacgtttgttttcaggtcacccagggagccggctcccagggctagccctgagagctgtccgtggtgctgatagttcccgtgtttcagcaaggggcagcctcactcagaaaccaccctggcggtgccctgtgcgcttctcctggatgtttcccaagggggaaggaaaggccttggtctgacattctgaatccacgatctgcccttcccagtggatcggggcctgctggtttgcggaggttcactgggaaggctttgagctgctgccgttacctcctggtaccatatttgcctctcagcatctggctatatttctgagacaggggaggagacatcccagccgcaaataatttaataaagacttttccatccgctagcctaatcccctcttcctccatcttttagtaccagggacatggagaccaggtcccctttcctaaaaccctggcccagttgccggcaagcggacactctctagccaacttctttactccacatcattccaggaactggctgactctctccatagctcacccatctcagttgcctcctcttctcctctcaaacccagccctcttggtaatattggattagcccactttcttgaaagctgattttctatttgcataatccttccctctcagagttgctagggcctccatgataagctgatgggccagggcagtcaagcaaattatactctttattctgaacagcattgaaagtgagggaaattattttttaaagaaaacacacgctttattttcatctccacattccttttgaccaggagcatcatgccagtgttgactgcactagcctatgtctcctggaatacatagatctttattttaccaaactacagcaggcagaatggaagtcagacctatggaaggtcttcttaatattaatagtggagagaatgcatatgaaagccccttgtaatggcaatacattactctttatatatataaatcatatttccacctgtcatctaatttttttccccatccaacactatagacaactgtataggtactttccccatgtgacagtggaggctacggaggctcagagagaccgtatgtcaagtcatggctggagtggaaactagagctgctgattagagtttctaggattcctgatgcactgagctcaattctggccaacaaacacttagcagtacccactgtgtggcaaaggcaccgagctacagccacagaaaggcttgggtacagtgaatttctactgcatgcctactgtgcaccaggttcagacattacaacctggaggatttagcccagagcacagacatctacaaaaagggggctggaagaatagtcaagaggaaggcatccttttccttgaggctcttctctttgtccagtactggacaaagggtagaatgacatgggaaacttctccctccccctcatgaacccttcacctgaagtcttctgagagccccgtgggcaaggggccccctgctgcagtctcccactcaaaagtgagtgatgctcttcattgagctgaggcagggccgctggctgctgagttatatttatacaacttgtaaatcatcctgtcaggtcctcctgagaaacccaggcaccaatgtgcaggaggtagcagcctctgttggcttcttcaattcctttgggacagttgcgctccttgacactccccaagttttttggctgcttaaggtgacccaccaaggatacacaagcaaagacagaagggatgggagagggaaaggggttcccttctttgcactgggctttgttgctctctccaagatctcttctagggggtgtttggggattaaagggacttctgtctaccaccctgcctacttctgttctcttctctgtctagactgattaaggagcagaatgtcccagaggcaagagaagggactcagtaaccaccaatggtaaggtggaccctgtagcctttggggctccagcaaccttgaccttgacagttggtgcttttagcaaagcccagtaggatggtagaaggaggactggattgggagtcaggaaacctgggttttagtcttgatttttgtcataagtacactgtttgaatttgggcatgtctgagcctcagtttccttgtgtgtgaaatgaagcccctgtgtaagaatgtttaaggagagaatccttccttagggtggaggcatgatacagtgaagagctcagacctgcattcaaagcttggtccttgcgttttccagctgtgtaaccttgggcagtttgcttcacctcattgagactcagtttcttcatcaataaaatgggaagatacttccttccatgtgatcttgtgagaatggaatgcacagcaaagctcagtttctgatacaaggcttagcacctagtaagtgtgcaaaagtgctcatctctccccttccgccaaatccagtttccagacatgctttctgcaactgattctgaaagagtaaccaggcttcagtgctcatctgagtttgatggtggacagaaccaggcaaggagccaggtccagcccttttttccctctctctccctttggcctctgctggggcccttttgaaagcaggcaaaacacaaatacatattgaaagaaattaaatgggtttggccactgggcctttaggtgaataaataaaacagtaaaaggagaaagattactcttaggttgggcacctgccacatcccctcggggctgagccacatgactgaggccagtttatgagagaaatctcagtggaactttggggccaggccagcttgggtttgcatcttgattctccctttgggcatctttctgatgctgaatggggccactctaagtctcaatttcttcatctgtaaaatgaggagatccatacccatctcacaatggtcaggactagaaagaaagccaccatgaactcattgtggacagtaggtgctcagtacaggctagtattccaccctgtcccagaatcatagaacaaatcaaggtcattcattttaactgcagaggataaagaagaggtctgaaaaaggccactgggtttggcctccataaagttcctgttggaaggaagtccccctacaaatgcctttcctccattctttgcctccccagaacctcttgcattctagtcttcactcttttctcttcatggggactttcctcctgacattttatataaagaagagagagagaaaagtgtgagggatgaggctcaaggaggaagggtgtgtgagtgtgtgtgtacacacataggatgaggaatggtacacacgtgtataggctgcagagaaggagccagtgggtggagagaacttggaggtgcactgatgtgaaagtcaatgaagagatgaggccacagcatgtgtaggcaatggcgggcttgggaacccaagtgaagggctcaccatggaaagaagcatgagttcttgggcagtaggggcacaacggtgttctggagttgtgtgtgtggtgacagacaaacctgggttaaaactccagctctgtaacttgctagatgtgtggcatttgtcatgtcccttcatctctccaagcctcagctttctctcttcttgaatgggtataaaaacatccccctcatcgtttggagaggcagtagatttaagtcaagactagcacagtgcttggcacttggaatattcttaacaaatgttggctccctttcctcctcatggctggagaagcacgcagaggatgagcgaagatgtggagaggggcaaacaggagggacactgaggatggtccgaggagagtgaaagcccaatgtctgtcgagggaaggggcaggtggctggtccaggggccaaggccagccaagaagcaagaggcccagaaatggtggcaggagagctttgtcttatctttgtgctgcagggtgggggagccccaaaattggagcttagcccgggagggttcttggcttcaccaggaaataattcagaggtaagccgatggtgttagacagcgacttctattgaagcggcagtgcgcagcagccgctgagggaatgctccttgcagagcagggctaccccacaggtagtgcacccatagtcatagtgcagaggccgttttgcactcctatttatacccactttcaattacatgcaaattaaggtgtgaattatgtggccatttctagaaaaagggtggtgacttccgggtcatcaggtcattgccatggaagggggcagtaacttctgagtgttggcatggcaatggtaaactgacatggtgcactggtgggcatgtcttatggaaagttccttcatgtcttatggaaagttccttccatccagtccctgttttagctattcctcagtttggtccagcgtccgagccctgcctctggagtccagtcccacctcctacctcatttggaacttctgcacagttgccataggaatccatcctggtcttggctagtggggccttttccacgtggaggtgttgggggccacctacctgaggggaggtatgcagagtgagggagcagcagatggagcctaggtgaagagatggggggacatcgctttgcctcgagaccagaagtgactggagacattctaatcagtcctatctcttgtattttgattcaaatggagcctaggactgctggagcacccagctggggaccccaggccaacccagctctctgttcctcctcccacttcagccaggccaagcatctctggctgcacctgcttcaggaagatgcttgcagcaactaaatgagaggacgcatgggaagcccttagcaccgtggctggcctataaaatgttttccagaagtgtcatgcaagaagggagaagaggagacagagaagaaaagccagtcaggggtcttaggtaggaggtgggacttgacttcagaggcagggttcggatgctggaccaaactgaggactagctaaaacagggactggatggaaggaactttccataagacatgcccaccagtgcaccatgtcagtttaccattgccatgccaacactcagaagtcactgcccccttccgtggcaatgacctgatgacctggaagtcaccaccctttttctagaaatggccacataattcacaccttaatttgcatgtaattaaaagtgggtataaataggagtgcacaactgcctctgagctatgactctcggtgcactgcctgtggggtagccctgcctgtgaggtcttaggtcttggccctctgggccagaacagaaggacctggtacctctcagaactcactctcaccatcagcgtccagaatgtctccctgccttaaccttgaagatgccagaggaagtggagggacttgggtctgtcctaggcagggtttcccctgaagccccccgacccctcagacaaggatttgagtacaaatcatgtattttggaggtgacgtcgggaagtattgtcaggggagtgtggatgtgaaccagcaaagggaagaaagccagtgaagttgtagcactgggcaggtggggctcagcttcaccagtgagctctgggaagtggagtagaatggagttgctaaatctccaatgtgtgtaagaatcacctgaagaggcttctgaaaccttccagagccccacctccagagagtctgattcagcaggtctggggcgggactcaagaatttgcatacagcaaactcccaggtgctactgatgctgccaaatcgggaccgtactttgaatagcagtgtagactacacctctgggttaatccccagcccacaaagggatggggaagctggagtatttatccacccactccgcatctgtccttgttgagggctgcttctgggggcatgaactctggaggttctggcgaccggataaagaacctgaggcagagagtgcagtggatggcagcaagtggacacgtgaggacggatgggatgaacactgtggcatctgctgcaagctcagagggtccggctttgaatcctggccctgtcttctataatttgtgggatttaggtaaagtctataatctccccaagcctcagtttcctcattgaaaaaatggggataataattccaacatcggtgtcattatggagatgtaatgagattaatctggtgcgagtgtctggcacatagtagatgcaccgtaaatgtttattgcatctgtagcagcgctgttccagaagcgggatgagagaggtctggttcctggagagagctggaggctgcaggctggcacaagccctgcatgaatccatgtctgcttggatcctcgttgccttaataagtaaataatcaattgagagagattcttcctgggtgctaagaaccaagtcctttccatctgcagccatccagaggcaagctttactagagacctggcctcaaggggctgcctgcgacctggcatgttttccaaggggctggtgaggcaagtctgcatttccaggggtggttggcaactgcaactgcacactgaatgccgtgggaatggaatgcattggccgcttccccttccccaccccggggtagctcccagcccattcttttccctccctcccttgagtatgtgggggatggcataaaaggaagcattctggacatccgcaggatggggcaattggcacctgcaagacaaaatcaagaatttcaggtggtgggaggtcgtgcagaaaagaggagaggtcaatggtggaaaatacggagggccacttggggaaataaaagaacaacaactcagagggttaaccatatcacactgagtttttctagtttataatagcactggggatttggatgtaggatgctactcagagccagtttcgggaaggactcttactgcctgggagccatttggctttctcaacctacttgcatcactgcttgtgaaacaacaatgaggtgagcctgagcaaagggaagaaagagtgtgggggtcctccagccccacccccacctctactaggcacctgctcagcaccattgcagtgtaacgggtccagttttgaaccaggcgaatgcacatctgagtttcaggttcatttttgcctctcactcgctgtaggatcttgggactccggtttttatttgcgatgtgaatctattcagttatctctggggtcctttttgctgacagcttctggatcttaattttggggaggtctctcagaaccaaacacttctccagccaagcaggtttagggagaacccagagcaaccttctctggcagcatcacccagagcggttgcgaaaagtgcggattcccagtcccactggggccctgcagagtcagacactcttcctgtaaaacccaggaattttcttcttccactgcatgctcatcccccctgactctcacacgtattgcattttgagaagtcctgtctaaaaaacaagaaaattttctcgtcttctttctcttctgtagtcagttaaacaaagccacccagctgggccaggtcacctgatgctggtgcatttaatatctaagtggaagcaacaactcatcaaaaggaacagtttacaattgcctgggataaaactattttcttttcaatcttccctggaaagtgacagataataaccagcctggagactgtaatattattagggccaaaaataaaataaaaccccttaactgcttcctcttacagagagaagccaaatagttcttcaactcatttaaataaagtgattgttttccttgctcattatcttaaattcccaggagtctgcagtcccctccttctgtatgaggggatggccctatttccccctctctcatcatttcttatttcacaagaatcccgttaagaccggcagcaagaagccatgcatttatgaaccacttttagcatgcttgctttctgcccggcccccaacccttaaattaaatgagataatatatctgaggcatatagaacaactcctggcatagagtaagtgcccaactcatgtttattgtcattattaatgacatttgaataccatgattctggtctcaacaagatagtctgtgccttcagacaagtcattgcacactgagccttagtttttccagcagtgaaatgggggagagaacacatggacggagggagcccagagcagggattattatgctagaatctcattacaggagggcatgaggacagatagcccctaggcaaaggggttagagttcttaaggccttgttatttccttaacatacctacagaacatacaggagctatgtctgcccccagaccggttggtgcaaatgtagctgaaggaatcattgaatttgacctaaacctctgttcttctaggaactttgttccagatgattctctgaggacaatttacctcctctatgctctgtctcctcttatcagttgtggtgacttagatggctcccgttaccttgacaaccctacccttccccttctctaccaaatgaagaagacagggcctgctttgcagggccatggtgaatattcaagccagcttaggctcagggccaccacaccgtgccatcccacaaatagcagctattacagtggtcgtgagcatgatgtcacaatcccggctcttttcacaagcctgcaaccccttccctgcaaaccagaaatccaaaaagctctgataaatgaaagatttattttattttgttctattttttgtaattcattggatgagaaaactgaacctgacctgaactgacttgaaatgacttggtggcaaaacccagcctgggtcgatgggaggatatttatggtatttgtttttctcacttagtatcaccatccaaatgcgtcactgcagaaatattaatgttgagtgattacacagtgattctttggaccccagttgtgttgtgtgatatattgaacaagccccatatcacctttcagaagtagggttcagcctgagctctgggacacatctggctccaagggttcgggatggtggttgtggaactagtgttaatgtcaggcaaaaattctcacctctgggtgtcctctgggtgttcctcctgcaagcttccattctgggaaaattgttgttcatgcagcggcctcctcacttgcccctgtacataaatccagctcaaacccacccacttgggtacacctgcatccttggggagcccctttcttggagtgcttagtctccatcctatcacgctgcccacctgcccctacaccagtccggtttccaggccaactcctgtgcccatcaggccactggaagggacagcgtcctccctgcctgacctccacatgcttgccttcccccatgtggcactgctggctgaattctctgctcttcactccgatttttggcaccagagccacacaaccgggatctcaaaacagaaagaatgcatttcctaggcaagcccgctccttccttaagctcgcaggctgaggagcgggcaaggtgcagccaatgggctctgtcccagcgcctgggccttccactggcattttctccagcaggttttcctcctgagccatagagattaagagcttggaggtgcccactgagggagaggcttttagggatttaatgcagccttgatgaagcccggagacaggggcaaggggttctttgctatcagaacgtgcagatgaggtgggaatgccccagaaatttaccctgcaggctctggaatagcaatattattatgaataatattgattgatcactttccatgtgtcaggctctgcattgagtaccttacatgaactatctcatttaatcttcacaagaccctaggaggtggctaccattattattctcattttatagaaaaggagagagggtcagagaggctaggtaacttgttccaggccacacagccagtatatggtagagccaggagctgatcacaggcagttggattcaagagcccaaattcttgaccatatgtgtatctgtgatctattaccatgaacatgctgtgtaacacttggacacagagcctcagtggtgtacaacaataggcacttttttctcacacattcaggtggatgagctaggtagctgtgcacactcatatgtctgagagcatctgacctttgactgacccaggctgtcctcactgggacaacaggagtgaccaactctgtcccatgtgtctcccatcctccagtgggctggcccagcatgtactcatggcagtggcccaagaacttatgtggaaacttgctaggcctccagaggccatgcactgtcactcatgcattgtcacctccctgttggccagagcatatcacatggccagcccaggtccaaggagcagagaaatagatgctgcctttttagtgagaaacgctgagtgtggacccaagaagtcgtgaaaatgggaacccttttgcaattcactacgtgacacaggggccttcacagccacagtgtgcacctatgtcctgcagggagacaagagggaccacctgagagtctcatgaccctggattccacctctgtgagctcccaatcaaactgaaagggagacccagcaaatggggtcaatgaaagctctctgctttcaggaacttccaggactaataagggagacaatatttgacctccaggagaggccagcatgatggaggagactcagtctctgcccttggagagcccatggcccctggctgtggagagctgtatgtatgtaactcaggctcagagagctcccagtaggacagggtaagcattgacctcactctaatgggaatgggttgtctaataggtgaggcaggacactgatataagcagaaaataaatgtcattgtacactgaggaccagctgatttggggagatacgggaagaacttattcaggagagtcaatttgtgtgggcgttttggaggtggtgaggttcagctacagttaaggaagcagaagcagctctcagctggacaaggattagaaggtgagcatcagggtgctcaggaaaacaggatgtggggagctcattttccagttccttggcctttgatggagactcttctctaccctgccctggcctcccacttgggcccaccctctggtaacatcctagatttcctctgcctccctcactccacagcagccactatggaaaaagacatttctaggctcagagggagagtggaaagaggtttggagaaaggcctcaggccactttgagaagcttggaaaaaggggagcatggaggaagcgggagaagagggtagctctgcggctggacctgggactttcccagacactgagctctcagatcacgggccctaggtggaggctgctttccttggaccatgcctgggtccaccgtcagagttggaggagctcattctgcagcctgtgtcttctagaacaggcctctaggagagaaggaactgcagcctgcaggccaactctgggccaccacctctttcataaataagattctgtttgaacacagccatgctcattcactcatgtattgtctgcaataacagactgagtagttgtgacccagaacatttggcccataaagcttaaaatagttactgtctagctctttacagaaaatgtttgccaatccttgctctatctagaacgagaacaccactaggacagggatcttcgtctgttttatttgctgctgtgtccccagtgcccagaactgtgcctggcacataacaggtgcttaatcaatgcatgcagaatgcaggaatgaacgacttggcctctctacaaatcatgttttcaaccacacggagcaatattacccaacccctttgttttaatctacttcgactgatcattttacagatgggaaaacagaactttgggaagtccaagtgagcagcattagtcctccagccagttagtagcagagccagctctgggacacaggactactgacccacagggcagggctctttctgctggacatgctgaaatgctcctcaacagcttcttaccacaaggtagcctgcaccatcagctaggagattttctcctttggcatttggcaaaagattcccagctgctgtaagtgcttttgggctgtggctgggggtgtcagggactcctgggtcccaagaagtgaagctgaagccgagatgggtcccaaagacaggtcaccaagcttacatgtgatatgtctggaaagacacccaaccccaactcaggtgcgcggtgaaacctgcagctgtggtttgcctcatctctcctccggccctaaggtggtcaccaatgtgccttgggagtgggggaagttatttgtcagaacttgcaaaacaaaaggcaatttattcctctgcagatccagaaacagatagaagggcgggaggaatcatgcatgtagttggtctccctcctgaaggtctccagggttggagaaagggctgagagctgtcccacaggcttatccggatggaaggcagtcttatgtcccacatgtgacaccaaaagcaggaatccctcatccctgtccttggcagattctacaagttgaaacacatataggacaggcccacctcactcttgatgatagctcccaggtatgttgtatagtaaatcctgtgcctgtaacaattcagggcaatctctttcctgagctggtcgattgttcttgatgtcctcagctcctcgtccaaacctcttaatccaggagcaaatgagctgtaaacaaccgcatcacatggggcgcaggaggagctgctattgaaggaggaagtgaggctgcagcagctttgcaaacagagggtcactggggattggggtggctgcagactctgatgggatcccatagcatctgcaggtgagggtggctgctgatgccgatgagacttggggtgatccacctggggcaggtcttggacaagtgtgatgccctgaggggccatttgggcatttgcctgagactttagggtgactgtcctttctcagtggatgcagaaggatccagacagccttgatcctgtgtcattggcatggatgcaagtgtttggggaggacttgttggaggaggaggaggaggatcagcatctttgaataaatgatacgtttacaaggaaaagcttactgtgggctcccctcagccaagaagtgagactgaacagaaggtctcttcttggcccagaagttctctaaagtccagagtctgcacctcctgctgcagagctgtgtctgggagctccataagagtcagagctgtgtctccaccatcagtctgatgattcctcaagaccagtaagtatacatgtgcaccggaccagcagctcctagtgggtgggtgctagatacccccagtctgaagcgcatctccctcatccctccagcagcaaggtgagccctttcttgctctccaatggtgatctcggacctttctttccccgcagggccccttgagaaagagcagagtcttccaggaaggcaagggcagccactgagttaggaactggaatttactgtgtgaccttaggcaagtccttttccctctctgggcctcagtgtccctcaaacaaaaacccagagacttttccagtatgttagaagcatccttccggttctctcagctcctgccatgtgccttctggaggtaaccttctaaggactctgcaccaaccaccgcccttcaccctcatgctatctccctttctcaaggaccccgggccccaaggcagagccaggtggcatctttgcacttacactggctgactctacactagctgttttgctccccattctgccttcacagcatttcttgtggttgaactaccagtcttgcagggaagcaaaatgaagagaccccaaccctgcctgccatccactcactctccaaagtgcagggaaacagctcctttgaagacctcaatttaaacaagggagagaacagttctgagattttcttcccactctcttggctccatcccttataatggtttcgttcccaagccccagatattctggggagggtgaatgggcagaggatgggggtgggcctggatgactcatgccctgcaaggttctgccaacactcggcatctggtcctgcttcatgcctctccagggcagcctcgggcaagagggagcccttggtgtcagaatgcagggagagggcactgagcaccaagctggcacctgggtgggaggtgtccaacacatgcagcttccttccctgtgcagagcatctgcagcaggactcttcttggatgctcagagcccaccattaactagagaccagatttctgaccaaggccatggaggcggccatgttggctgcactgaaaacagccgggctccgtgacaatgggcttcctgcccttcgtgcagaccccaccagtggaggggtgttcttcagcctccttcacatcagtgtccatcagagattcaaaaaaaaaaaggaaactacccaaactggtgccatcaaggctgtcactcactctcctccctacgagccagccgcatgtgcgatttgacacactggtagcatttctgcaaattacacatcattctccccactgaagccacacctttgactgctgtaatatttacctgaccgtgcaagtaattttcaggcttcacttagtgggccactgaggcatggaagaaagcagggatggcgttgactttggacagcaggcccaagagaagctgaaatattattagaaggtgtcctaatagctcagacaagcacagagagacagctgctcgcagagctatgggcagaggattggttttcatggttctctatgaagcattgtctcactgctgcttacatgactctgaggatggagagctcaccacccaccgtagacataccattccatctctgagtgcctctgacagtgacaaagtactgtattgacactgatgatatctgtcatcccataacttcaacccattaatgctgcctctgcttcatgggtgatgtagaattaaggtgatcagctcattttgacttgcccagatgtttcccagttttaacacagaaagccccacatcccaggcctccactttaatgagtaactcagtgtggtttgtctaaacctatccagattttaagtctgaaagtcctgcatcctggtaaccctctcaatcacaagcaaacctggcctagttatcaccctatgcagaaaaatctatgtcagcaaatctgaaaatctttcctcctccatctgatagcctacccaaggtacaagtgcggttgctgtgattcctcttgccctccctcccctaggcaccccagggaggcaggaaagatcaaccgggagcatcagtggctggtcctgtctctagaaggagcaacatggtggatgggccagactcagtcttgggctcaaacccacctgtgccacttcttagctgggtggcctcagccaaagccccagcccctcagggctgtggaaggtgtcaaggagattttgggtaggaagccccaagaccatgggtgagtagctggcatggaggatggcaccttgagaggctagggatggagtgtggctcgtgatggaccaacagggtgtcattgagaggcagggcagcatggcaatggtcatagcctgagttccaagtccactgtattagtccattttcatgctgccgataaagacatacccaagactgggtaatttataaagaaaaagaggtttaatggactcacagtttcacgtggccagggaagcctcataatcatggcctcacaatcatggcagaaggtgaaaggcaagtcttccatggcagcagacaagagagaaatgagaaccaagtgaaagggttttccccttataaaaccatcatctctcgtgagacttattcactaacactagaacagtataggggaaaccgcccccatgattcaattacctctcaccaggtccctcccacaacacgtgagaagtatgagagctacaattcaagatgagattgggggtggggtgggggggacacagcgaacccatatcaccctctctgccacttcctggctacatgatcttgggccagtcgcttcacccctccaggcttcagtttcctcatctgcgtggaataagagccctgcttcctaaggtagttgggaggatccagtgagcaagtgcacacagggcacttagcacctggccttagatgagttctgaggaaatggtcgcacttccactgttgtcatcgctgctctccacatcattatgttcatgctgaagatccatcacccatgtgaccgcgacagccccttcttccattttccagctttggaatgagtggtttggaagaagctggatctcttaataggttgagtgtgtcccctcggctcttgccagggacctggctgccctggggcagtggagagggggcctctcaagcctctcacagtcttgcccactggacaaaagaggcattttaattcaaagatgcacttaactttaaagatccctcccccagaattttccccatttggcctttgacatgcattcaaacccctcagatgacagagatatgtgggaggagacaataaaaccacaaaaggaatggacaagaggcccagcctctgtccactttatgctcaggtgggagctggtgtctttccccgttactggccaggtctccttgcccccactgggccctccaatcccttctccactagcagccagacggatctttttttttttttttttttttttttagatggagtccccctctgttgcccaggctggagtgcagtggcatgctctcacctcactgaaacctccacctcctaggttcaagcagttctcatgcctcagacagtagctgggattacaggcacatgtcaccatgcctggctaatttttgtatttttagtagagacggggtttcaccatattggccaggctggtcttgaactcctgacctcaagtgatccacccacctcggcctcccaaagtactgggattacaggcatgagccaccattcctttcctttcctttcctttcctttcctttcctttcctttcctttcctttcctttcctttcctttcctttcctttcctttcttttcctttcctttcctttctttctttctcactttctttctttctctctctttctttctttctttctttctttctttctttctttctttctttctttctttctttcgtctttctttactttttttttttaaccactctgcccataaagtccttgctctctggggacaacaaaacaaaacacaaccagatctataatgaaaagcaaatgggtttttttgttgttgctgtaataacaccaagggtttgttcaaagccaggtaaagatttttttttttaatatactgggtgattttttattgaacagtttccttataatagaaaccaacactagactcttgaacttcctctctcccaaaggaaataaaccaggcctcctgcagacgaggtgggagggaaaacatgagcacagctctcactgggacctgagataggagctgcccgtgctacctctcaggctctattaggaccccagtgcctaagtctaactcctgggtgtggctgaaatgcacctggcctgggagtttgaatcccagcttcgccactagtctgctgctctatgtgttgggggaaatcactcggcctctctggtaaagacacctaccaagtcaaagatgagtcaggggctcacatggtccagttagaagaaaagaattgtaagtgtgtggcagagcatttgggtattggctaacttgtttctttaccccattattatactaggactggagatacacggtgttgggcaaaatggttccagcccctacccttctgcaatttatagccaggtactatcaggtatctatggcaaaggcctatgaaggctataaccacaccttcttgctcaacactccagaccttgtgccttatcacaaagctagcctcttagcctgggctcaagaagtaagtatgtacaggttctggtcaggttggccagaagaggagaaactgaactcttcctggagagattaggaaaagctattgacctgagtcgcaaagaatgagccagaatcagacaggtagatgaggaaaagaggggcttataagctagaccaggggttgcctaactctggcccattggccaaatctggccatctgtttttgtaaataaagttttattggaatacagtcatgttcattcatttctggattgtccagggctgttttgtgctataagagcagagttgattaattgtgacagacgctgtgtagcctgcaaatcctaaaatattcttacagagaaagtttgctgtccactgatctaaacaaaggagtcaggccaaggaaaggcccagaaatctctttcttgcttagaactagaattggccacctaatgactgggcatggtggctcgcacttgtaatcccagcactttggtaggccaaggtgggcggatcacttgaggtcaggagttcaagacctgcctggccaacacggtgaaaccccatctctactaaaaatatgaaaattagctggatgtggtggcatgcacctggaatcccagctactagggaaggctgaggcaagagaatcgcttgagcctgggagacagaggttgtagtaagccgaaatcgcgccactgcactccagcctgggtgatagagtaagactctgaaaaaacaaaaacaaacaaacaaaaaagaagtggctacctaaattgtgtggcccaatgcagaatgaaaacaggggcctcttcttaaaaaccgattacaaatttcaaatttcagaagcagagtcttaaaccaactgcagagcccttgtaggcacaggtctttgtgcagctcttgcaggctctgggcagagttagaagttgcgctcatgctcttccctgggaaaccacactgggagtagatctgggaggcagtcttgacccagggatctaagctggggcttggcgtctccaatccccaagccaaacctccagaaagaccagcctcggatctactccccaagccaaggggatggagaactgaccttcccgtctcagcaatcccgtcccattcttggagcctggctgtgatgagaagcagaggtgggcccagctgcctctcccaccgggagtgtcttggtgatcagacatgcagcagccataagaagacacatggcagtttaatgggaccctctctctgacgatgctgttctccccatgctcacctggaactatctgatgggggagcagtggggaaaggaacctcacctcacccaactatggaacagcaaaatgagaacaagggctcatggaaaccttccatgctaggtgtccgctcaaccccaaccccttagattcctggactaaagtctgtgtcatctgcccttccattgcacagacacctgcaggagacaggaagccagatggaaatgcggccaaagtctttattccccagctcctcccagtggggcccctgggtccctccacccaagcttttgggtggaattcttcttcagctgctgctctcttggattcagggagacctcccactcctttgcccccttcccttttctcctaagaggactacagtccccaccggtctctgccccagtgttgcctcatgccttattggaatttctccgccgtgcccatatctttgtaaatcaccttggaattaaggtcttcttatttatgatcttttcaaggaatatctgtttcctgctgtgccctgcctggcacaaccatcttcccccaacccaaatggcttcagtcaaatagagccttgtaacagatggaagttgcatccacacttcctcttgcaaaggtgggtgctgaacagggctcctccttggcaagaagttgaccactgttctggctgagcaattctaatgcttcccctggtgtctgctgggatcactgggtagtattcagtgggcggctgatctggtctgcaggggtcaaggcagctttacccacctgcaggcatggctagaaggctggctcagcaaggtccccctccttctccaggtggcctctctagcaccacaatgggatgtcttaagcagcagctcaggatgtacttgttcccagagccctgaatgaaagcttccagcccctaaggcttgggcttggagattggcacacgtctgccacgtccgccaattctattggtcaaagcagtctccaaacatgtctagtttcaaagggagagatcgtagaccccccgacccccgccatctctaatgcaggaatctcaaagaatatgtgccatctttcatctaccacacattccttcctctcattatcatcaccttcttcatttgctgagagctggggtcacaagccattgtctggggccaaatttgtcctgcagattgtgttaatttgatctacactggggtttctgtttttaattagatgacttggacctgcatagactccctgtctcaacactggtcccacccttcccgctgcctgccaggggctctctccttggctcctggggccatcgtttggtggtcctggactaacaggtgcatgggaccagtcagatgggccacacacaaggacactcatacatacaaattatcagaacttttatataactcatctctcccagcccaatttctggaaataaatgctggttcaacaaatgtgtagaccttttctgaagtctccaagatggtgttggggaaagagacaggactgagagacccaggggcctgtgttcttgtcaccgtactgcctggtggccttgaatagatcgcctggcctccctgggctgttgcttctgcattgtgcagaacaaagaaaagatgtcacccctgcatcgtgcaggacaaaggctggggtcaccccaagtttgaggcccagctcctgcctcttgtctcaggccgatcactccatcactctggcctcggttgcctcctttgaagattggggccataacgtgaatcccgtggggtggttgcaaggatgaaatacagtgccaggcacggagcacttggtcctgacaggccctcctgtacactctgatgctctgtgcctgcgtggggccttcagaggccaaactcccccgccctagctgagactcactcacctctgtgtctagcacaggggctgacacatagtaggtgctcagggaacccttgttggattggactgaccctttgtcaaacaaagcagtagcaagagaaatgaaaacgtgactttttttaaaaaaaagaaaacttgtgcaagaatgttcttagcagcttgaagcatagcagagcccaactggaaactgtccaggtgccttttaacaaaagaacagcttaacaaacatagcgtctccttgacatggaatactactcagtgattaaaaggaataaaccatggtacacacacagcaggggtggatctaaaaaatattatgctgggagaaaagagccttccctggaatctacgtaccgtataattcgttgatacgaaattctagaacaggataaaatgtgacaaacagattagaataacgatcatctctcgggtgaggtttggctgggaaggagcggagggaattttctggagtaatggtagtgttctgcatcctgagaagggctcagcttacactggtgcacgcatttgccaaaactcaaaaagaaccctgagtggtactcttgagatttgtgcaattcattgtgtgtaaatttgacctcaaaagaaaaggaattgtaaataaatattgaactctaaatagaaggtttaggagtaaactgtacaggtgtctgcagctcactttggaaggcatcgaataaataaggctgtgtggctgcatcgagagggatgaatggagggtggggggagatatgataaagcaaacatggctgcattcatttatttatttatttatttatttatttatttatttatttattttattttgagacagagtctcactctgttgcccaggctggagggcagtggcgcgatctcagctcactgcaacctctgactcccaggttcaagcaattctcatgcctcagcctcctgagtagctgggattacaggcgcccccccaacacacctggctaatgtttgtatttttagtagagatggggtttcaccatgttaaccaggctggtctcgaactcctaaccttaagtgatctgcctgcctcggcctcccaaagtgctgggattacaggtgtaaggttttttttgtttgtttgtttgtttgtttgtttgtttgtttgttttgagacagggtcttgtcctgtcacccaggctggagtacagtggcgagatcttggcttattacagcctcaacttcctgggctcaggaaatccttccactgcagcctcctgagtagctgggactacaggcacataccaccatgcctggctaattttctgatattttttgtagagatggggtttcaccatgttgcccaggctgatctcaaactccttcgctcaagcaatctgcctgcctcggcctccaaaagtgctgggattacaggcacgagccactgcacccagcccatgttcacattttaattgtggaagccaggtaatgggtatatgggtgtttgccttaaagatttttacactttcctgcatgttgggaaatgttcgtaatcaaatgttgggggaagaaaacatgaagctatagaactaagctagggcttgtctctgagcctcatctgtcaaatgcagacagcactacccagacgggcaaccctgggatcaaacgagaagcagtgaataaagaggagcccatggggacgtggcaggaagcaacttgattcttctaagcaagcggggccccacctcctcatttggatctcagcttacatgtgaccttctgaggctgccctcccctggccacccatctcttgtagccatcaccctatgttaatgtctgcatggcaattctctctagctgatacatctcttccatcttccttaatttaaggtatatggctcctgacagtagaatgtggattctaggagaagagggacattgtctaattcatggcaatatctctggcacatagtggggacacagtaactctttgtggaatgaaggaagcaatgagtagggcctgcatatgctctatcgtaacccctcaagtgtagaattctgccacccagaatttgcctagtgttaacgccacccccatagaacagcaggaagagaacttagcaatcagccatcccctgggccccatttaacagatgggggagccaaggcccagagagggaatgcaaatttcccagcatccgctaccagtgagtggctgagcagagatggggcccaggtcttctagctcccagctcagtgttcttcctctccaactggctgctggagctcgtggtaaagtgctgattcccaggaacagccggcagatggacagacaggcttcactgggctgggctgccctgatgccatgtgttaattacagcagacaggatatgccagcctagcaatgtttgccggtgcacccgcccctcgtttagcaggtgggcaggctggcgcaggccactgatctgccacgggtctgccggcggccgatcatgctgacacaggcccaattgtgcacagcgcctgctaagtggggtgggccaggcagattggcacagcaagggccctctccgaggactggcagccccttctgactgcattggtcagccagactggtacaagctgggcatctgtcccatgatgagcccttgctggacacaacctgtctacacaggtgtgcccactgaccggcagcccggggggtgacacggggactgagtgctgagcatgaccatggggagaccttgtagggggtgtcacaggcaggggatgtgggccagaacctcacacacaggtacacagatactgggatcagataggactctgccatgctcccgccccccacacctgccctgttgactggtgggatccaaaaatcaagtttgcagccctgaaagaggggctggaaaagtggtctcttctctccaacccaatgcctcttcccaattgccactagttctactgttcacactgcagccagggggatttctctgataccaatggagctgatcactctcctgtttgaagccttcaatggctctccatttccctccaataaaataatagtaataataatatgcattattagcattttacagctaacagcactcagttatagcatgtgtactatgtgaaagacaccttctaagcactttatagggaagaacccgattcatcctccaccctagatggtggtgctattgctatcctcattttacaggtaaggagactgagacagggagataggagatctcaaattgacttgaacctagaggtctgactccagagcctaaccactaccaaacccagactccacatgtgtgagccatgaccctcccacaccaggcccttctacacagcacccccagaacttgtcctgaacccccctcactctctacccaagccttgccttcttgttgatgcctggggacccccatgatctcctcctgtctgccccgaaggctctgcttcaacctccaaagcagggctcagggtccccttctgggcagggcctgccctggaccctccctggcagagctccccggcctgcacgccagtgccatttccactccatgtcagcagcctgctgctgagcgagcacctgctgctaatgtttctctcctgaccccaacctccacctcacccattctgtgaactccctgatgacccctctgtccacaggcctggcctgcaggaggtgtttatgaatgaagaaatgaacgaatgaatgaatgaatgaatgaacaggcaagtgaatgaatgaatgaacaggtgagtgaatgaatgaatgaatgaacaggtgagtgaaagaatgggaagctgaggtcactggggttacaggaatgcacaccgagggtgtgtagtgaagagtggctttctgccgggcatggtggctcatgcctgtaatcccaacactttgggaggcgaggtgggtgcatcaccctgaggtcaggagttcgagaccagcctggccaacatagtgaaaccctgaggtctctactaaaaaaaatataaaaactagccagtcgtggtggtgggcacctgtaatcccagctactctggaggttgaggcaggagaattgcttgaactcaggagacggaggttgcagtgagctgacatggtgccgctgcactccagcctcagcaacagagtgagactctgtctcaaaaaaaaaaaaaaaaagagtggctgtcatggagacacaggtggctgaataagtccctcctccttcctcctcagcccactccttccagaacacaagaggggagggcatttgttaaactgggaaagagcccccgagcccctctctttaggggcaagccatgtgaccctgaaccctgtctctaatgctgggattttccaagagcatacttgtcgggaggcagggaggaggcagcgaggagctggacatgatcacctggtctggaggagggacctgagtatctcaggtgctgcagctgttcagccctcggtgaacctgtgcttttagggtctggattccaagcatctggatttgggggtgtggtggaaagagggtgtgcttcggagcaaagagcctggctcccagctctgcggactcctccctctgtgaccctgggcatgcccctcccctctttgggccttggctttgccttgtgtaaaatgagagccctaaatgggacagtcaagggcgctcctgctctgaatgacctcctagggcaccaagggtccagcagttgatggccccctgggaaagctgcaaagagaccctggtgaggagtgggcctgggggttccggactgtgtatccggttgtggttcctgacccctgtgtccaaatgacctgatgacgcttgttaaaaatgcagaataaggactgcattcagaagtcactgagttggaacctccaggatgggcttccggggaaactgacattttcaaaccccacccccactctggcccaggtgattccactgtgcactgaagttcgaatgtctggcatctatctgaggccctttctatttcccctgcttcctgtctgctagcccctaaagcatgaagcgggagcggggtgctgcatgggaggtggagaaggaggtctcagagctcccatgcatgtgtctgatagagtttggggggctcaggtgtttgggtcgtgactgtgggctttgtattcgactggtgggtgcctatctgggcatgggaaatggcaagggagatacaaccttacatttgccaaaaactcatccccttacatacacacacacacacacacacacacacacacacacacaaacacacaccctttcccggagtgaggagcagggtatataattgcacttacagctgtgggtgcaggcattgtgcatgcacaacaccgtaagtccacaaactgacacgcagccctgaaaatgcctgcatacactctcttacactccctgtgagacctcctggtcttccctgtgctaacatctaaaactacgcatgaacattctcattattactttgcctttcacacacatgtacagcctcgtaggcagcctggaaacacacctatttgtacagtcatccctacggatgcacagatgcacacccatactccgttgaacacaggcttccttgttcacagcaggctcacccacgcaggatggggtcccagctcacaccagtggcacacacctcctcacacttgcaggagcacctgcccacatgtggagtgtgggtcctacaaagaagctgcagccgctctcctccctgccactctccccccagcccccaggcccatctctgagctgctgtctgccatcgcacggtaaccggatgagacaggcaatttatgacaccagctgtctctgtcaaaaccggatctcccacacacaccaggggaagccaattaccttgagcccagccctgccagaaaccggggcccacaagggagagcagggactgcccagagaggtgagtggcacctgacatgaggattttctgcctcttcttgtctttgggcatctggtatcctcttcccccaggcccccttggggaggacagagcctgccctaccctctctgaggctgcttctctggcccagctcccaggcctaggaactgcaagagcggtttcagggtggagaacaggtgggcagggaggtttaggggaagagtggtccagggtcgttatggcaacaagaaagggaagaaccctgtgcccctccccctacacagcaggcggccaggcggctgaatcattctcccaggcttcctctccgccttcattcccctcacctcttccctcaacacccctgccctggttttcctctccctagaatacctactccctttcttgcccccctgcccgaaactaaagccaactctactacctgagccacttcctgtctggactttggaatcagacccatgttcaaagctctccatttcaccacctcctaactgggaatcagggcaaatggcatcccttctctggccatgggttttgcatccaaaagaaaaaatgatgttcattcctataaaaaaaaatgttgaaaaggagtcttctaagtaccagactccgttctataatcggggatgcaacattgaacaaaatgaagtcccaccctgggcttcaggctccactgcaggagtcggaaaccacacgtttcagaaatttagaagagatgagtcagttttctcactgtcctcatctgctttgtttacagccatactcccagcaccaagcacagctcctgaaaggacctcaagcaatagacaaactcacaaaggcaccagtggactcaagctctagcctgaggttgacttggtctagtgccatctttgtgcccagccttgcagggcgctttctaggcatactttctgagtgggtgggatggcggcagatctgcttaagtgaacaggaagtccgttccttccttcactgactcattggttcattccacaaatgcacattgagcatgtactacgtgccggttcccatgctaggctcctgggatcaagtgagatgggcaaggactcccacttgatagttgcatggcagaagtttctagatttgctcatcacctcccacagtctagaagctgagcaataaattcacactaacagcagtgtccacttgcctttgcattttgcaagatgcttttacatatgtttgtttcttttagtatttctcacaactctggggtgtgagtttgtttaatatccctcgcgttacagatgaggaaactgaggcttagaaacaatcagtgacttgcctgagaacccagagccagggagtgaagcacccacagtaaaactgagtccctttctagccctcattgtctcttgcattatctaatttaatgcccttttcccctaactaccatgaaaggcaggtatcgccttaggctgtttacagccagggagcacctcttgcctgggctgggattggaagctgtgctgggctgacacaagatcccaggtgccatccactcctctatatctaatcagttcattaaaaccctccttgcaaacactctctcggctgcctggacacagagacctcagctgctccatttccaggagagcaaattccttcctggctggagaggagttgggataatgtagacaggcaatttaaacagccggcaaaatacaccagcagttttcactctctgccactattacactttccagccgtggcgggattggcccataagtgggatatcaagtttattacagctatttccaacctgtaattggttttgtggaaaacaaagagaaggaggttgggaaggtggggggaggtgatattttccccttttcttttttttttttttctttttcggatgacagcacccagggacattggtgaggcagccgaagttggagacttatttgtttttcaaattaaacagccaggccggtcagcgggctctcacactgctggctggactaagtccaccggccacgctttgatgactctacttgaaaagcaacctggcctggctgcagcctagatttgctggttggggtcagggggcagtcagggcccagaggtggggtctggcagctctggagcatgagaaactgtggtctctaggctgactcttctagaatcagaacactgcgggcattcagggcagcaaagagtcctcagtttcctcatggaacatttagggaaactgggtcccagagagaggaacagtgcagagacaacctttgggacttagaacctagctctctgcctctcagaaacttctacacagtgtagctggtcatttgggggaattcctggctgagatgctctcagcatggggaagaaaagagacacctgttcttaagaacccatgttacggtctgctgccatcattgcagtccacccaccctgaccaacctccctacttcggacttaagaaaaatacgcaatagctaatatgatggagcactttctgttacgatgacaggaggtgatgtttgcaagcaatatctggcacagggtaggcgccaatgtatgccagctattgttattcccgtcatgctattattaccgcatgccaagcaatcccctgggctctctgtgtgttcactcttacgcactgaattctcacacgtgtgccttacagggaggcatgatccttcccgttttgcagatgaggaaacaggcacacagaaccctccaacctcacccagcaatcaactgagtggcagagctgggatctgattccagagctgtgtgaccccaaaagcctctgcacatttcccatatccccaacctcaaagtaggtcttctgctcccttcttttggactcatccatgctgagcggtcagctctgctgtttactattacaagtataatacatgtgtgaccttgggcagttcacttgcctctttcttggccgtggttcctgtctgcaaatggggatcatgacacacgtctcttggtatagttcacttattcaacatcccttcgtatgccaggcactgtgctaggctctgggatacagggctcttggagcttacagtcctgagattccaaggaacaatggaagggagggctgggggacactcagcctgtgtaggcactggttaggatgcagattcttttgcataactacgtgcacagcctcttctgtctggtccaggtgtacgctttgcagagttaggatgttttcctgcacagaatatcattaatgctgggagctttaagaaagagaaagcctgctggttccttttggagcctcacatcggaggtggtctgaggccactgtcccgcctgggccaggctactcttaccagggagtcccagacagatcagggtccaggcacagcaggctgtcctggggccagtctgtatcgcagagcagcaagggccttttcccttttcttcatggtattcccagtgcctggcacatggtaaggtctcaactcattcattcactcattgactcatccagcagatatttatcgagcgagtgccatttgctaaattctggaaacagagcaatggacaggacagataaagaccccatcttcggccaggcacagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaataaaataaataaataaataaaaataaataaaaataaaaataaaaatacaaaaaattagctaggcgtggtggcaggtgcctgtagtctcaactacttgggaggctgaggcaggagaatggtgtgaacctgggaggcggagcttgcagtgagctgagatcgtgccactacactccaggttggtgacagagcgagactctgtctcaaacaaacaaacaaacaaacaaaacaaaaaaaaaatccacccatcctcatagagcttatgttctaggagtagctcatattcaaggacctgtgtgtttgttcatcaaaagtctgttgaatatggagtgaatgaaatcattcatttcagaagtgcctctcgctctggggccaggcaaacccacacatccacagggcttggcttaccttgtctgccttgtcacctctgtggttgtcggtcggccctggcctcgtggtccctacccactggcaccatgggagcctctcagagcccatgagacctgcctgcctccaggtactcactcagggcatccctgcactttgttttgaagctgctacgatgactactagcaaattctcggtccctgctctctgcaccccactccttatagacacaacccagccttctggcaccttccacctgcctccctctctgggtgtgggctcccttctttcatttactgaattccacatcctctggcattttagcaagagatgctttgctctccagccccatagacagaaagagccctggagggtggggagggacacagaaaaacagatggtccagaaaggtgtgagtgctcgtgaaaataccccatgagtgagcacttcccacccaccagggactctacaaggctcatgtaatcctcatagggaggaacgttgccttatccccatttcacagatgaggaaactgagactaggggaggtggaatgacttcttcagagcacaaaattaggaaccgaaatcaaacattcaactggggatggaggaaatcagccttgcttcatgctccaaagcctcccatagacagaaagagccagcctaggaccaagcactccctgaaaagggcctacttcctccaggaagccttccatgatcacccttccctccaaggggattcttggctccttcagaagtgtcagaacatcattggataacacttggtaattacctgttgctgctgcagccatcatcttactgactctggaacctcagctaattgtggactgtgtacctcttgtgaataaggtcgtaatgggctgcaaccatgtctgaaatgtatttccttctcggccgtgaggctgcaactgcccctgtatgtctcaggcgtggagaaatgtttctagaattaaaggcgaggtgtcttccagcacacccaccacaccttctgtccacagcctgtactaataatccccaactcccacctggcctctttcttgggccctctaaccaccaggaaccacagaataacatccttgcaaatagctgctagcccgctggccccacctgagcgtgtctgagcctcccatttcctttgccttccgagaggctgagggaggaaggagtgtgtaccacagacagctgggacagtggggcctgccctccagatccctcaccctgcagctgagataagcacttgtctccagctgcctgaagcaggtttcacagaagcagttatttactcctctggctgacagtgaggccctgacacagccccagagaaacagatgtaaataaaaccaaaggaaaactagtctcgtccttgaaactcccctgtccctcagcctgaaacagagatttacgactcggataattcttcagtgctttatctggggtgtgtgggtatgtgtgtggatgtgtggggtgtgggtgtattttcctcgtaataaaaccctcagtctcggcgaataaatttgaggagacagttttactgacagatttttttctcttttgtgtaataaaaaaaatggagtgaaatttgagattgggacgataagggctgccgcattttaggaggagataaaaaagcagtacctgaagggaggtgaggccagaagacgggctgccagttaaacaggcaggatgccttccgctttatgactttgggagaaaaatcctcacacctccactgagattctgacatcctttctcctaatgagcctggccaccaggggtggaaagggacgttgagaggcattcagttcacccgcagtctcttccagcctgatgggatgggatgtgaactctggtccagaagccagacgcttgtcaggaacctagtgtggggcctcagccgaatcattttgcctctccaagcctcagtttctttacctgcaaaatgggaacattcttgtctattcggctctgttcccagggacctggtacagccacacaatgtgatgggcttaaaactgggtttctccacctgggcactgttgacatttgggggccagataattcttgggaggggggcaaggggctgtcctggacatagtggaatggtcagcagcttcctagcctctatcagctagacactggtacctaccaaaccgcacctctcctccccagttgtgacaaccaaaaatgtctcctgagcttgctgtatgtcccctggtggttagggtgagcaaaatcaccccccaagtgaaaaggccctgctttaaaggtactttggtggctgtaaaaaagtcaaatgggtgaggcggggatgggaagagggtgcatggagaatggggagcccctggagggtcttggcctctaccccaggctgggacattgggatgtggggagatggaagctctgatcccaagtacagccaactctcttctccaccccatgccaagctggacacagtcaactcagggacattcttctgggtgatgacagtggacgcagagtcaaggtgtggttggttggggtgagcatctttcttggggtgagtgccagcagggatcccaagaggagaggagaatcctcctgtccccgtcctcctcatcttcctccactctcatggtcccgtttcagaagctgggcctgtgctgcagaagcagccaggtgggaggaagtggtcctctgtctcccctctgcacatggtcagaaagcgccaagccctcagaggggaagaaagtgacgcgtgtacatgtcgctaagtcccgacagagataggaggggtgtgggcttacggaggggtaaggagaagccgtgccctgggaagtctcactgccgcttcctctcagggtcccagagcctgcgaaggccttctcatgattctaaccatcccccgtcctcacagaggccaccttactctttacaaagcttgcaggctatggaaagtgactggcacagacgtagcctgtgtctgcacacagctggttgctcaaccagtgctggccagatgcacggagtctctcctaaaccagtagcaacaccacctaggtcagagagatgtggtccaagtcagcttgggtacatatgtgtccagaggagcccagctgtgtctagggccagtactcccaggcaggtgacagggggacagattcacactccaatcctcacctttttgcctggggaagctgctttcagcatcccccctaccccagccccttggagtcacccgtccctagccagccccctccctgcccctttccccgctgcctccaccacacagagccgcagggagctaattccacttctctaggcccaggcatgaggcctccccattgcaggctgttagcgcagagcccagctgagctgcgagaggctgcaagctcccagtctataatagagttgctgagacaagcggaaaaactgcagccgagtaaacagataaataattgaaacagtgacaacacataccttgctgcttcgtggagtaacactttcattagctggaggcagcgcagatgtggggaagcaggcgggcggcagctgagggcacggacgcttgggttcgctttccatcagccatgaacagcgggacagcccggcagccttgggcttccagcgctggcttcatcgccacctccctgccttctcccacttccgcattcttaggtgaaatggggacttcatgtcctctctcctggcccatcccaagacgagggcaagtgccccacgctgtccccgtctgcatcgcccgtgccgggatgttggattcctggcctcctcccgggctccctgcctctagtcttgcccctttcgattcatcctcaatctatagccagaggagcttgtaaatctaatctaatcctggccccggggaccaccgccttcaggagaagctgagctcctttgctgtggagaccctccatgatctggcccacatttttcttcgcagcctcttctcatcccacttcctttcttctccaggtgctgtgaaggcagcaagcttcccctgagcgcacactgctctttcctgccgcagggcctttgctgttccctttgcctagaaaactcccacccgttgccaggctggctcctactcttccttcaggaggcaacttaaaacatcgctgcctccaggaagccctcggttattaccttattctcaggatgggggctgtccttcttctgggcttcctgcctgcatcttgtcagtgtcctggggaaaggggtgaccagggccggttgagcactcacgtgtggctatctctgtgctctgtggcaggtgacggatggtggcaccatcaagcaaaagatcttcaccttcgacgccatgttctccaccaactactcacacatggagaactaccgcaagcgagaggacctggtgtaccagtccactgtgaggtgagtgcctgggggtggcgggccgacagcgggggaagggcggagggatggggagtggggcagagggcagttctccagccctttcacatcaatccctcggtgctcttgggcttggaaggcagaactgggggctccccttatggaagtgggacccattccctggagggacatcccctggagggaagaggcaggagagggccaggccaccgctcttctgactggcctcctctgccagctcctccaacagtcctggaaggtgggtattccaaactccatttatttccaagtgagatactgaggcccagagagggggagcaatgggcctaaagtcacacaggcaacaatgacaccgctgggcggtgaagcagttctgcccggcttggaagctcaaacaccacattctactgttttttgtgtgctccaaggccataagggccccgagcttaagagagaatgaccccaagcaactggactcccaggtcagaagcagcagggtgggaaggagcagtgctcaagtcggagatgcttgattttcctaccccatccctgttttccaggaggcgggtggcagaatcaagctgactcgatcttccagagcctgctgttctctatgtgtgtggctctatctccttcccacaaactccctacaagatcctagtcctgttttatccctttgacccttaacacacaccggtccctcttctcaaagggcctttctcccttcggtcatctggtaaactcctcatcagccttcagaaccccactccagcaattccacccatgggagccctcaccttagctgaactgatcccccaaagctggtcggctgcaactgccccagtacccacccctcctcagagggaatctcactgcattcatgaagagtgcacagctttgcacacacacactcttccacgccacaccgccaaatgctttgccaggtgcccagcctgaaagtagtggtctgctccaaagctggagggggaccgtgctgcatcgggtaccgtgagggggactgcagccccggcaagcccacatgatgtgcactgtggcaccatgctatgtggatgtctcagctagtgcctggtactgtgttgtctttagactgagcctggaggagggggaagccgtactctccagcacgggctgtgggtctctgtgaccgtgagctccaggaggacaaggcacatgctcctccttcaccttgcatccccagctctcagcccagggcctggcacacagtgggtacataatgaaatttgcaaaatgagtggacaactcaggctacactcctcagcccttcaggcctgttttctattgggtgaaattagaaagcgggacaagaagattgtaaagggtaagtccaaccctgcatcaagaatctgacccaggcatcctcctctgcctgcttttgtaaaaatgggaaggtgagtgtgctccccaggcggcccggctgggtcctcgtcctctctgggctctgtgccaggaccatgctgagaatgtggacgtgaaggtgtgtgaagaggtgtgtgaacagccgcacaaactccttcatccccctagttatgatttctcctgaacctgcttccaaaaagaaattatggtgccttaaaatattaaagcacacctaaaacaagccagttacaatcaagatgaaaaaggagataaaaattcattttggagaaaatagctattctggaaaccacagatggttttgtagtaagtgaactcccaaataatctccacgactcccagaagcctaatgccacccagcccacccctgccggtcactgtgtctctgagaattctttcctcaccaagccacccgctgccaccagcaaggcctctaggactccttggttctgatttctagctaagaaagaaacccagggaccatctagaacattcctgagcaccaccctctcctgcttcctggagcctcaagggcaagccctgctaccagaagacccagatgaaaatcccagctcagtctctgcctactgtatgacctgggatgagagccttaacctctctctctctctgcttcaggtccttcgcctgtagagcagacttgacatgacaggctttgtacaattgtggaatttcagtgaaatttatgtccaacagcctgagttcaaatcctgcctcttccacatcctggcattagtgaaatctggggctggtaaccccacagttgagtttcctgacctccaaagtaacatgacagcactaagaggctagctgcaagttgtgaggagctgatggcgtgcattcaagtgaagtgctggtttccggcctctaagtggtacatgtttgctgccattgcctagaacaacctctccttctcccaccataaaacaaaacaaaaaaaattcacctttttacaaatctcataaagcctccttttatgcgctttctgttttgatctgcacaaacaaccccatgaatgcaggcaggtattattattattaatcattttctctagccctgttcttactacagaagaggtcaaagttcagcaggcccaacagtctccctctggaatgacatgaacttgaccagaccccttgcttttcagttgtggaagccaaggcccagagagggaatgaggcttgcctgaggtcacacagcggccctgacttaagcctgatatcaggagccagtgctcttttcttccccacatgggggccaatctccctgagcctcagtaacaggggcggtctcccaagcaaagaacaccccagggagctgagccgtcctgtttggtgaccaccaagggagagggaaggaaggagcagaccctctggagcctaacgggatcacggaggattgtcagccctcccaaccagccatgctgggggcgactgcctcttcaggctgcagagccccatcagggctggcgacggggcgcgggactccgcatttacatataaatgaagatatttacaaattaatgcatctcaacgagagagagtcccagctccacagctgtctgagccgtttcctcttcagctggggaaagtagggagagaatgagactgagaagattaccaagaattggctgagagcaatttcgcgggtagcctagaggagccccaaggactcctggagctttttgtcccactgatggggccctggagggatggaagtcgggtggatcatcaggacttctgcccccagggggtgcaggtgtgtatccctggttgtatgaccttggacagatcactgcctctctggatagagcgtcccagaggcacatctatcaaatgcttttctaggtcttagccccagagcccagaactcccaggttggaattgacaagaatgtattccctccaaggctatttagttgagcacctactaggaccttggcttggtggaaggtgcccagggatacagggggaatgagaaaagcacggctttgcaatctagtcggagagacatggcaaaatgtagatgaatacatcattccacattctgcaaagaagtgattctaaaccatgggcgtgtaatgaaggggcaagtggggtgcagtaccgggaaggaatgagatgctgggtgccatttagatgggtggtcaggcagggccatcgaggaaggtggcacttgggtggagaactgagggcaggaaggagccctctgtgaaagggaggaggcagatgtggccgacagttatcccaccctgcccacttcctcttacccctcgctcttcctggcagtgccagcatccttggtgcttccacagggctttctcagggcactggagaccactcagcctgcacatgagaaaggtgagaagtgccggggagttgacgccaccccgggagcagccttgaccaatgactgtttattgggtgcatacccagccccctcgtccctccagggggacagttcagatgcatgctcaggaggacaaagtacaagctcctccttcacctcgtatgcccagctctcagcccagggcctggcacacagtgggtgcataatgaaatgtgcaaaatgagcgggcagttctgggtatgctccttggccccttgggggtgtttcctaataggtaaaattagaaaatgggataagaaggggggacattgagaaactatgggatgaatgctgtcaactctctcccggagtttctcagtgaccccccagaataaccttgagaaggcacccgtattggcttccttcccttctagctcattccatcagcttcctgggaccccttctcacataaaccctttcctcctaaatccttgtttcaaggtctactcttcattccacccttctaggttcttggctgggtccccggtagcaaaagacgaattcacaagacaaaaggatacaagtctagtttgtatacgttttaggtgatgcaggagattttataaggaaatgaagacccacagaagtggttctagctgagtgttttttgctgggttggatgaagggtggggagtcatgggaaagtgtgaaggatagaaggacctgagctaagggcagtaaactggggacactcagcagggtggcttgttcagatcccttggaagtgaagatgctgccttcctccaggtacagagagggaacctctcacgtgaaggtcttgtgacctgcttcagggaaaggtcagagagtccttcctgcgcctgccatttctcaaattccatctgcttaaaatattcaatataccaaggtgccaaatttgaggtggcgtgtcctgaaccccctccccatggaatgtggccattccagagggcagctgtgacctccttggaggtccaagtgaatcacagtgaggcttcaaccactccgcccacacacatgctgtgtcttccatttcctgaagcaccctgaggcccttgtcccattcgatctgctcaggaagcgatgaggaacactggacagatttcactggccttaattcactggtgcagggaatctagattcgaggggctcagtgtattcctgcccccgacctgctattgcagatccctccaacaccttggccaatgctctttgccaacaaggtcctacttgtcctttcaagttcagcttaaaggttgcttcctacaggaagtcagccccaactgctcaagctcaccgactgatgctatgtcttcagagtctgcccgcccccccactagactggaagccccatgaggacagggactaggtctgatgttttcaccaccatcctctccccaacccccaggacagcacccaaccctgggcatgtggtagatgatttgtaaatatctgtggggtgaatgagttcgtggtgaacatggtggtggagtcctttcaatgcaacacttgctgctggggtggatgaacaagacaccttaggaaaggaacatccaggcccccgttccttcccccaacactcacatcattcattcatcacaaaggaattgagtagttaccatatatcagggacaatgatggagataaagtggtgaacaagacataatcagacctgctttcgggaggtttctgatctagtgggtgaggagagacacactacaaaaatgcctttaaaataataaggaaaaacagttacagtgtgtgatgagtgtggtgaagggaataaggtacaactgtccctcaggatccatgagggattggttccaggacacccccaagcagataccacaatcctaggattctcaagtcccacatataaaatggcacagcatctgcacatcacccacgcacatccacctggatcctttaaagcatctctagattacttataatacttactatcatgtaaatgctaggtaaatcattgttatactatatttttatttgtattatttatattgttgcattattattttttttctctgaatatttttggtccacggttggttggatctgcagattctgaacccatggatccggaaggccaactgaaatgtgatagagaggggtgagaataatggagtgagggcattgcacagctcctcataggagatacctggaatgtatctccaggaatctggagacatctgagcacagatctgtagtataagaagccagccaggcaaggttggggcttgggagggcactccaggtagacgacatggcaagtgcaaaggtcctggggtgagaaagagcttggtgtgatctgggagctgacagagggccattgccaccagagcacagtgaatggggaggtcagctgacgttcactctctgtgccctagaagctgctgaagggtatggcatgctctgatatgcggtttgtcaagctcaccttagttcctgggtagagagggtgggttggaagtgccagggaacgaagacaaagccgtccacagaggagcctggaatctgacttccaggtataaagtattcaatataccaaggtgccgtatttgaggtagcgtgtcctgaagcccctccccatggaatgtggccatcccagagggcagctgtgacttccttggaggtccgggtgaatcacagcgaggcttcaaccactcctcccacacacatgctgtgtcttccatttcctgaagcatcctgaaagccacaggtggtggggaacagctgggcggggcagggtggacctgggggccatgtagagaaagccaatgctgggctgcaccttttgatgtatgtttatcaggagggagactcgggagagctggagtaaatgaaaaaaagaggctgagaatgcagggcgctggaagaaatgccacttcctttattactctgaggtgcatcggttcacatgtacactcaacagtgcacaataagcgttggctgcatttgaggcacatagctacggtgcacaaaagtggctaaaatcagcccctgcctcttcggagcttacagcctgttcctctcccttcacgcccgttggcctataagctcctccaaggctcagctatatcttcttcatctcagtaaccccaggacctacttggcatttagaaaggaacaataaatatttgtggaatgaaaagagagaaaggggagataaaacacgagataaatagctaacaattcaagtaataaagtgatcgctgtcatagagaagattcagatataatacaatgatgaatcagagatgcagagactggggaaatcagggtgatgctggcatttgaagtggttctagaggcatcagtgggttttagacaaagaggagctgggagctgattctctggtcagagggccccatgtgtgcaaaggcatggcaagaggaaattgaccaagtagtggcaagaccactctatgggcagacaatggcttctaagcggaagctctctggaatctgttcaaatgaaaaaaataagggattgatttttaaataggcacattaactgtttggttcaaagagcagaggggtttgtttccctttgaaaagttaaatgatccttctacaatctattcatgtggagaccaaactctttttttacagttgatacaaagaaaagtgccatctgaccctcgttgatttcaaagtctgaattctccagctcccttctccctctgtatattttcatgaagcatacgtcttctttctctaaaatatacctaacaggtgctgcttgccacatgaagtggtcattcatttattgattcttttgaccactcagcaaacacacgttgttgttgccaggcactcagcaacaacaaacacaggccctgcccttatgaaactaactctccaagaatacgctcagttcctgacctgctggaaacccgttcctctctctcccacccagagttcatccaggagtgtgaatgagagagagtggaattgtttattttattgtttttaacagattatgcctcttagcattagaattgaaagcccctggctttccaccccaagtgggaacctggtccccctctcaaaatcaggggtgattttagaagacagggttgcaggtctcctcccagccactagggggatgctcagcagccttcagcagccttaaatttcccatcaactggccagtggctcatgcctgtaatctagcaccttgggaggctgaggtgggaggatcacttgagctcaggagttcaaaaccacactgggcaaaatagtgagacttcttctctagaataataaataaatataaaattacatatcaactgagcaacaagccacccactggtggtgtctataccacaggccagctcactgactgcctgcatcaggatcaccttggaagttgctttaaaataccaattgctgagctccaccaagacagaatttgattcaagcccagagcaagacctggggaacctggaattcatttgctaaaaagtcttccaggttaagatatgggcagtgagatttggaaagcccgcttcacacaatcccatccacctgctcggatgtgcacactggggtcaaagaattcaatggccggcaccaaggcatagataattctaattgttgctggtccctatctgccaacaggtggttattctaaggcccctaaagccagaccacttttaattgaagatgatgaaatagccaggccagccagtgacctaagagtccattccctgaggccagagtgaactcacaggcaccagccagccctggagcttgagctgcccgcatacctgggctgccagtcattagcaaagcaataatagctggcatgtgtggtgcactcattggccagaccctgggctaaactcctcaggaagtgaggccttgcctgcaggccaaagggaaggccaggagcaagatgctctttctgtagctccctggccatgacactctccccagagatagagtgtgcgcatgctttccagctagaagttccactggacccaatcccaggcctcctacccccagagctctaattaggaaaggggggcccccctttgtcaggtcccagagcaacgctccgctcagactgcaggaatctgctctcagccttcctccctggttctcatctctctgactaggaccctcccttcttcatctctgggtcctccatgctcagcccagctcctgggatagatgcccagggcctccgtaaagatttgtcgaatcaatgggctgaagggttgtattccaatgtggaattatcatttcaaacagttagcaaaactctttcccaacccatcatctggtttaacctgtggagcacagatctcagactcattgaatcctgttattcagatgctgacatggaagaacgagaggaatggtcacttgtccaaggtcaagcaggtcgtgcagtgggaagcctgggttaacgcccaagctgtggcactccatgggccattggagccaggtccacttgtggggcccctgggccatggagcatggtgagcaggtcatccaacaaatggtaattgttttgtttgtttgtttgtttgtttgtttgtttgtttttgagacacagtcttgctctgtcgcccaggctggagtgcactggcacgatctcagctcgctgcaacctctgcctcccaggtttaagagattctcctgcctcagcctcccgagtagctgggattacaggcacccaccaccacacctggccaattttttgtatttttagcagagacagggtttcaccatgttggtcaagctgatctcgaactcctgacctcaagtgatgcacccgccttggcctccaaagtgctgggattacaggcatgagccactgtgcccagccccaacaaacagtaattgatgcccaccctgtgccaggtcacttagtaggggagactgacacgtgagcttgtctctccacccctacacacatgtgcgtgtgtacacagaggatctacccaggatgcttggtccctccaagtagaaagttgccaggatcagtcatcaccttaaaaagagccacagcttggcagtcccaggcccctggatgccacagccagggagagcaagtgatgcctactcttggctctgggagagggacctgggaagccagtgccctgcattttctctgctctcttggctggtagcatcaattccattgactagaggagaaatctgtttaacctaatgtgtttcaaatgctccgcctcagtccccatggagctgggcacactcccctgctccccatcttcccctgcccctggcaccttctcactgcctcccccataccggcattgacctctcaggttcccacttcttctctccttcttcaggggctgcctggccttctctgccttttcaaagcccaaaggtgctccaggcccaagctccaatgctcagcttgacgcagcagccctccccaaccctctccccagtggcagaattgaacctgcctgctgtgcccagggagcgccccatgcattccactttagccttctcctgctggctcccacctgtccactcgcatgtctactgtctccaccaaggccatgagcagcccagacagggcagggctgattcttctccatggctcctacctcatgcataggagcaagctccacagaggaccggcaccatctccctaactctctccacctcctgttactgaaggtggacactcttctcctcttgttccttgactttcagtctttgattttcctttttagaatgatattcttctcttctttctctcccccctttccaagagcccacttcctattgcggtgcccttttcctgccatcctgtgcacacaggcttgcacggtgttttcattccctctctccccatgcattcttgcatctcttggctaggagtccctctgtggtcctcaaatctcccctgcaacacagactccagatcttgatgccccagaggcccctggaacttcaaggaggctcccgtttccaatttagaaggagggtcaggggtatttctccttggttgggtcttgggttagtgaagacatttgaggcagggaattgagatgatccctgttgcatccacagctgccactgagttctctacctaccttcccccactctctatttgaccttggacccacaaggaggccactggaactcccagaacacacccttctgacaccagcctagctccccagggagggaagcacttgcaaagctgtctgctgccctctggtgatgcactagggtatggcaacttgggggctgggggtcggatttggtggggggcgtcttgcctggggcccccaaccaccaaggatgggtcttgtttctcaaggctagggaccctcccttattcatctctaggttctcagtgcccagcaacgggtctcaggaaaggctcgttaaattaatgggctgtcaggttatccaaatatggaattatgatttcagcaaaactcttccccacccattgtttgatcaaaccctagcaaccatcctgtgcagtgcagatctcagactctatttagggggctcaggtgcagcccagagaagagaagcgacttgcacaagagctgagagctccccgttaaggcagaattttcctcccccggcagcctccccagctgaggaggctgagccctatgctcatggaatagggtgggggcactggggtcacctgttcccacctctgggtagtggcttgccttgatcaggggccttccagagacagcatcttcacccagaatcagccatcaggaattgtagcccagtgccaggaagcaccctggggggagtaatgggaagttagttccgatgttgaatgcactttggcatgtttcaagcacctcaagtaagggcttgacttaattattcattcgtccttttagaagtgtttgtttattaactgtagacatcgggagacagagatgagcaggacaggtaagttctctgtccccatggagctgacattcccagggctatgctagcaacacagagagaggtggggaggcagtggggctctgccaggaagaggttggatatggtcagcaagggtgagggacacaggcatccatgtattaaatcatccaatctgcaggtgagtttgaggaccactgttatagaacatccttggtcattagagagaacttgaattgtattcttagagtgatgaggagtcattgaaattgacctcggtttgagttttacactgccaaatgatgaagcagggagattggggtggggtgtgatggggctggacaggcggaggtggagagaagaaatggggatgaattaggaagcagacctggcagcactcgctgatgggctggaagggggacaccagaaagtgagagagaagttaaacgtggcccctagggccatagccattgcatttgggaggagaggggctccttcctgagaagaggtgactgatgaagacttgctctggctgagggtgtaggacagaactcacgagttgtttgaatcagattagacatgtctgttagatgcctgagcacagccagcaagtaggttggtggaaacacagggcgggggagaagttgtgaccacagatacaaatatgggagccaccaacacacggatgccacttaaagccaccatcccctccagactcgggacagatctgctggcagccttcagacatcacccaggccaatcctctcattctccacctgagaaaccaaggcccagagactgtggatgacttccgtaaggtcacacagcaagccagccgcagaatcaaaagtcaacttctgactcctaaaggagaactgtttccattccacagtgctcaatgcagcttccccctgacctgcagcctgctgggcagaattgctgatatggcaaatcatttctatgtctgcagtcaggaaaccagagctgttggaaattatctacacacacacatacacacacacacacacacacatacacacacacacacacattatccttttccttcttctaagtaaaaaatcagtaaccaggctgtcagctttattactaattatgcaagtgctttattgctggtatttaaaaaaattgaaggctaaaaatgtccaggaaagacccaatttagtaaacagttcagaataaagtatttgttgccgtggtatttcttcacattagaatttgctccaggtgcttcaaaccttctttaatatattatggcaatctaataaaattcccagttctgggagaatctttgccttggaagataactgtgtttcagggagtgagggttaggtggaattgaggatgatcgggaaggtctggtgagcctgaagttcctgggaaagtaaggctgagagagggcagaagatgagtggttaagagacttgcctgaggtcacagtaagcactcaataagagatagggaaggggatggatggatggatggatggatgaatggataatggatggatggacgatggatgaatcgatggatggatgcatggatggtggatgggtggatggatgaatggatagatggatggatgcatggatagataatggatggatggatgatggatggatggatgcatggatagatggatagatgcatggacggatggatggatgcatggatggatggatggataatggatggatgatggatggatagatggatggattatggatggatggatgcatgcatgcatggatgacagatggatggatggatggatgatggatggatggatggatggatgaatggatggatggattatgaatggatggatggatgatggatggatggatggatggatggatggattatggatggatggatggatgatggatagatggatggatggatggatgagcttccagatgaatcatcaggtttttgcagacctaaatcttagtcaaggaaaagaagtcatctaaaacttgccattgatagaaatgacagaaataaaagttggtggaccattgggccatttgtacaaaatatgtaccattgcctctatttgcaaataacagacttcaactgagataatgaagcaacactgcacaaagctgcagggcagggaagccgtcctcattttacagaaaggaaggagatgatcggacacattgagtaacttgcttgaggtcacatatcccagtagcgatggagctaagacaggggccagccttcctcatgtccagctaagagctatagttttctttccagctcacaacttaggtcctttctctgtgcatcatggcttcttgccacctgagtttcttctacacccacccagcagccagagtgagctttctaaagtgaaatcaggtcacctgctgcttgaagccctccatgggcttcccactcacttgggatagaacccagtctcccatcaggcctaggataccctgtatgctcggccccatccacctggccagcctcatctcctaccctctccctcttcagcttcctaaacatcagcttccggacaccttggccttctcgccaagcttgttcttacctcaggacatttactcatgctttttctctgccagatacattcttcttctaccctggtgtcagatcaaatgtccctctgcagagatgctttccctgactgcctcacctccacccagaatttcccacccctgtgtcccatcattcttaacccattgatccgatttgtttgcttgttttttaaagcattgattactacccagtaagactcatttatttatctgaatatacattttcctttttccctctcatatcaagcaccccgaggataaagacttggtccccctgcccctcctctgtccccctagctttcagaatggcaccaggcagcccctccctagtcaggggccaatgtagatttcatatacggataagcgaattcctgatcagagggcctggctgttgggccatcagctggcattgagcagagaggcctgggttctagtcctgatcctgtgacagagccatagggtgagctggccagtcacacaatgtgtctgagcctcagtttcctttttgtccaatgcacaaatgtgtttgtgctggatgatgggaagccccctcagcttcacttatcggccccttcctcggtgcacgattgagagaaacaggcaatagaccaggccccagggtgaccaggctccaggcacagccaggactggggctgaaaacctgccaccttccaggaacccagtcagccgattggttctgcgtattcgcatttggattctcaggggagtggcctgccctctcaatggcaatttccttgtgagctgggctgacactcctaattattatttggagaggtttggggaggctcagttaattgattacatatttccttccttgacagggcatttgtttggccatgtcttgttttttttttcccctgcttggttaatgttcctgggcatgttgagtattttgtggggaccatgggactaagtccagtcataactctccctcctcctccccaaccctgccaggggctttcgaacactttaatttaacttccctggacctctgcttcccccatgggagcgatgatatagcaagagccctgagatctgaggactaataataacagtgctcacagtaatgtttatcaagttcctagcatatgccctgctctgctctaagaactttacacacatcgactcatctatcctcacaatgttacaacgaagcaggtcctgttatgatttctatttgtagatgaaaagatggagctcagagaggttaagtgacttgcccaaggtcacacagcaggcaagcagctgagccgggattcaaacccgcctgctgggtgaaaactcagcaacagggcacaggctgtccatcgctgccctgtgagtgctccagcaggcttgggaaaaggggatgcgcaatccccatcacccttggccacgtgcgggcagacaggcagctgtggtcggcctctgccgggagctatcagtggtgacactgggcaggactcagagcttcagctccttcattggtaaaaggaatcacaattctgactcctaagctgcggtgagggctgtagtggttctcatcttcagggtgcctaagccagcatctcgtgcacagtccatgaagtaaaggagggctcgaccccaggcccttgctcatgctgtgcttcagaacttacatgcttattctcctggatggaacaattgtcacatcataaaatgcaatcgtcatcttaaggagaaaaggtcatcgcatcatagatgaccctcccaacggcccctaaagggacaccctgctcccttgggtgacctcatgagcctctctcttccatggtttggtgaatgtccccctcctcctactagtctgtggctcctggagggaggggccatgtccacatctccctcatcaccgccaaacgctcaccccggttcccacagagctcagcacaaagaggtgaggagggaacagaagaattaacgggggatctggcctctccctctgcttctaggggaccgcttcttggctcctctccctggccagcctttccaagtgcagcccatgccctatccaccttctggccttgagacatcactggacatcctgttcatttcttcattcagcaaacacgtagtgagcacctctgatgcaccagaggccaagtgcggcgggatgattgggtcatagaaaaagccagagcccctccacacacacacacaaagagtttaggtttgcagagcacctgtacggtttaaatatcttacatggattctctctttgagctccacaacaccccttgaggcagctcatgccccatgtcccatttttatagattaaaaaactgaggcccagacagacatgtaatgaggcagttatagtacagtgtgcaagctccagaatgggctgtgggagccaaggatatgtgtgttccatgcccgggcttcctccacttctgacctcccccaggagactcagacatgcagcaggagcccccttttctggcttgacctgagtgtggtgggaaggcaggaggatggccttgatgacctgtgagacctgtgggcccagcagagcctgagtccatgcccaggacctatgcagcctgcagaagagaccctggatttcaaggcgggcatcaggctagatcagggcagtggggcctggcaagcccaggccagggcactcacaggtgcagcctggagctgctgggaagtgggagccacttggcacctggtggcaccaggtccccatactcatattgctacctccaaggaggggatgcagctctgcctcagagctccaccagctgggtgagagccccctcactgcatacccccatactccccgcccccagcttgccccgagcagagccactgagaaacaggaggaggtagctgtagggagtttgtctgtgggcctgatgccctcaaagggcttccaagtggaaatgctactgtcattgccctttggggaatgaaaggaaatataaaggcatatttcatctctgtagccaccctaggggcaatgatgccactgtttgctaataataacacacactcgggtctagggcttactgtgtgccaagccaagtgcacttacatgtgagaactcagccatggaggggatgccactgttaaccccatttcacagatgagaaacctgaggcatcaaaagcttcaatgccctcccctaggttaggcacctggcaaggggcagagccaggatttgaacccaggcagtcaggttagggtactggcccttctccactagaccacaccccctcctttccccattggcgtggaagttcatttcaggagaaccccacatctgtccctttgacaatgtgggcctctctgagcccctgcactgcactttccatgacagggagcccagtcctctgcaccctgggtgacccttctctccaccgcctctagccgctgctgagggccggcctccttttgcctctgccctctgccagtgtgggaggcagcagtcagcagggaggtgctgcggtctgacagaggaaataccagggtgccctgggagggctggagctgctggaaacggagcaggaccggcagagtgagctgattaggagaggctagcaggggagggagagacagtttggactgagtctccacaccattagctctcctgctctgtttctcccccacctacccagactgtgatgccagccgacgaggccctggggggtgcatggaggccctgccagctgctctagctgctgatgggccaagggggctctggacttgtcataagctccctttacacaccactaaagatccccagtcccgcctgtggctgcatgtgcctcctcctttgctcaacaccccgccatccccagcctcatgaaggctgacagaaccaacagatgccttggtgaggccttccaggctctctactgtggaatccctaccaatttattttccttttatgttaaaatataacatacacacagttaagggctttataaaggagttggtatccatgcacacacagctgcccaggtcaagataaacattctcagcccctcatgaggtttccttccaccaagagggaggtgctattctgacttttgtatgaacttagactagtttttccttaagtctaatttagactattagaatgtcagggagatttctctatgtggttgctcgtagcagtggcttgttctttttcattactacgtagtactccactgcgtggaccttattagtttatttacctattctcctgtggagtggcattggagctgttgcttccagtttttgagccatgacaagtaaagctgctttgaatgtaagcattcatttttcttggaggtatcccttggagaggacgtgtggggtgcagggaaggcaaatgttcagctttcagagatgctgcctgtgcttgtttgccaaggctgctgtaacaaaatgccacaaactgggaggcttaaaacaacagaactgtattctctcacagttctcaaggctagaagtctgaaatcaaggtgttggcatggccacacttcctctgaaagctccaaggaaaagtcatgccttgcctctcctcacttctggtggttgccagcagtccttggcattcgttggcttgtagatgcatcaccccaaactccacctccatcatcacacggcgttctcccgctgtgtgtctgtctctctgtccagatttccttcttagaaagacacagtcactggattagggcccacccaactccagcctgactttatcttaacttgattacatctgcaaagaccctatttccaaatcaggttacatccacaggtctcaggggttaggattcaacagatcttttgggagtggggagcgcaattcaccctacaacaccgcctaacagtttcaaagaacatgtacacattcacatccctgccagcaggatatgagagccccaggtgccccacatcctgtgtgtcccccactcttgacccagctgcaaggatgactccctgtttctgaaagtgtccaccatgcctctccccatccagacattgcagaagcagcacctgccacctctgcctggcaaacccctccccatccataagactaatcactgtccccaggagcctccccaagcacatctgccctggccaagttcagcaggccctccctctgcttcgtctctgcactttggtcattctggacagactccactgtcattctgtgacagtgaaggctgcaggctctggagcggcggagctggtctttgaaaccatgtgaacaagtgtcttcacctctctgccatccatttctttacctggattgttccaggaggaagcccagtgtccacatggctcctgtattagtctgttctcacgctgctaataaagacatacccgagactgggtaatttataaagaaaaagagatttaatggactcacagttccacatggctggggaggcctcacaatcatggcagaaggctaaaggcacatcttacatggtggcagacaagagagaatgagagccaagtgaaagggatttccctttataaaaccatcggatcatgtgagacttattctctaccatgagaacagtgtggggggaatagcccccatgattcaattatttcccaccgggcccctcccacaacacatgggaattatgggaactacaattcaagatgaaatctgtgtggggacacagccaaacaatatcagctccctcctctggtccctctgggtctctgctcaggtgtcacctccccagagaggccttccctgaccatctgctccaaaatgccaccccatcaccaggttcaccttccttctgcttctccgtagcgtgtatctctgcctaggggtgggcacggcatcctcacttgtttgcccatctcttgtctccctcttgcactagaaatcaagtttcctctggtctcctgatcacagctccatctttagcacctggtaggttgcctgaggcagtcaatgcatatctgttgaatgaatgaattaaatgaatccgcaaaatgaaaacaaaaatagcatctactggcaggagcaggggtaattgtcaggagattcactgagataggtcgtgcttagctaggttttagcccagtaggaactcagtcaacgttaactgttgtgttagctttttattgcttctgtagcaaatcgccaccaacttagtggcttaaaataacacaaatttagtatcttacagttctggatgtcacaacttcgagatgagtctcactgggctaaaatccaagtgttgatcgggctgtgcttcttctggaggctcaggggacagtctgcttccttgccttttgcagcttctagagcccacccacataccttggcttgtggcctctttcagcaatggcatcgctctggcctctgctgccatcatcacatcccctcccgctccgaccctcctgtctccctccaataaggacatttgtgattatattagatccttgtgggtagtccaggataatcttccccatctcaaaatccttaatcacacctgcaaagccccttctgccactaaggaaacattgacaggttccagggatttgaacgtgggcatttttgaggcaggaggatgcattacataccacagctgtggttatcactgtgacaatcactcaccatgtccaagtttgcttcctctgttggacagtgaccttgttgcaacacggactgccttcttctttctttctgtgtctctagttccctcttcagggcctggcatacagcaggggctcaggaatgtggcctgagttcctgaagggcaagagccccgttttactcatccctgtacccccaccatccagggctgatcctggccctgaacatttgttggaccgagcagacccgccgggtaccgtgcatgaccggtgaggacagggccccagcagagggacagggaggaccgccgggaggaaggtgagggaggggaagaaactcggggaggtctcgggcttcaaatgagagaggcttgcccttgccccacctcaggtggatcccttccagggaaccagtcatggaactgggtctctgctatggataataaagctaaaacataaggaacacttcagacaagagtgagatgttagagccacctggagccaggctcctagcctctgaatcccagctctgccgcttcctggctgtggaatcctaggcaagtcactcatctctccatgccttggtttccccatctctaaaatggacatgatgataatagtgtctatcttgcagagggctcatggggcttaaatgagttaataaagctcttagaactggcacaaggtatgcaggatagggggctggtgatgattatgtgctaacattttctgaatacctgctgtgagccagatattgtgctgggctccagggagacagcagtgagcaattctgcctctggttacacagggctctccatctccacctggataaggattaatattgctcccattttacagatgagaaaactgaggcctagacctgccgagtgcttgcctgagtccacatacttagaaagcagaggagccagtatttagaactggcctgcactctgggccactgcgctctctcacctttcagatttgcagtgctgggacccagagccctggaactctgccctgaatctttctggaaaacttggaaacagttttgaagcagggggtcttttcctttattacagccgtctcaggaagacgtgaaaatttggctctgatcaaattaggcccatgttgtgatataactttctatatccaccataaagctaataaactaataaattagacagaatgaaaatatcattgggcaaggctgcacactgaagcattgctgtaattactctcacggccggggccaatttctcaaatttcgccttggccaagtttctcagctcaccgtgtccctaataaggcataactcactctataaacattaaattgacttatttattttaaattacagtggaactgaaaccaccttgataaacctattctcctgcatctgccttcctcataagcatagcccagtggtttttttttttttaaacaaagaaaatatctagtctgtctcaggactctttctccaacccagactagctacccctttcttaccacgattccagctttagagatttgactcactcccctgaggttagcggaggtcgcccattatagataaagatgattcatgcctaattaataatgataatggtgctactttaattgagtgggtttgactggtatcgtgggccgggccctctgctacggcctctacaggaactcacttaaacctcataataagcctgcaaggagcgccctctcatgatccctgctttgcaagtgaaggagccagggatcagggaaggcaagtgacttgcctgagaccacacagagtgacttgcagtgaagctgggacccagccagggaggtctcgtgccaaagccttcgtcttcatcactgtgctaccctacctctcagaaaacttgcaccagtggcctgctgggacttcaagctgccatgagacatatttatttcttgagcggtgggaggggctcaaaacctggttgcagggaggaggaggggaagagctggatgggcggatgacatccaggctcagcggcaggtacaatgatggggactcttgctgggggtcccaggaggccacaggtatcttcctggcccagctgatggaggtgcaggagggaaaggggtttgggaagttcatcagagatcatgattggtgcatgagttggggttgataagaggacagcatcccaggcagaggggagagcagggacaagggccaggcagtgcttccagagatctgtggctggagtgaagggaggagagtgtggcgatggggcggggataggagaggatctcagcagtggagagcatttccacggcccatctctgctctccagggcaggtctcatttggccgcatgcagataatgcaacagcgagctgagagttttgctcctcctcctgatctctgctttcatgtcccttcctaggtcagcttttcctgacgttctagtatagcctggtcagatctttctgttctcaggtctaccagcaccccagatgcctctgggaactcctcacactattaattaaacacatatttaggtggttaattccatccctgtctgcaacactagaaagtcaggtccatcagggcaggaatcatgctcatcttgctcactgttatcttcctagtaattaccccatctaccattgagtggcacatgctagacactcagtgtagaattgttggatgagtggatggatgatggatggatggatggatggatggatgggtggatgggtagagggtggatggacagatggtaggtggatgatggattggtagatggtaggatggatgggtggatgggtagatggatggagaatggatagatgatggatgggtagacagtgaatggatggatggtggataggtgtggatggatagatggctagataagtggatggtaagtgggtgaacggatagctggaaagatgagaagtgaatgaatggatggatgggtggtggataggtgtggatggctagataggtagatggggggtgagtggatggatagctggagagatgagaagtgagtggatggatggatgggtggatggatggatggacagatgtgctgaaggtttaatgagatgctgtgtagaagcctccagcatatgcttgacatagaaaagtcatttggtgttctttaggttggaaacacaaagccccggccatgctccagtgcaggtattcccgcttgactctcaagcttactttctggaaggcagagcccctgatgggaaaccaagacccagagccaacctcaagcagaggcatcacgaggccaactgaggtccttggcccatgccattcacagggcctgggctttgccaggcgatgatgcagagcggtggcggttaggtgccccagagactttgggccctgtcagagcagagctgtcatcctgtcccctcctccccagcatgaatctgaccactgctgaggccagagggaatgagtttttgagctgattattggagaatggaagtctcccctgctgttaagggagcagtcctcagggccttccagaaaccacagctgccctgccccttcctaacccttgcttgtggactcagagggtcctactcctgctcagggctctgcatggactctcctttgtatcatcctctatccaaccttgaactctggtgtgaacaattctcctactgtcttgtgtgcaagcccctgcccccgtatttcatagcaggtccctaatgcaacccctgtccctaggtcccagctgtagtctgtctctgggatgccaattcctcccggataagaccctgatttgattttacctcttggattgatagtgagatctccattctttttgtgtaactctgggcatcttattagacctctctgtgcctcagtttcctcaactgtaaaatgaggatgagagtaatagtacataatatagtcatactacctcataggcagcacagggttgcaagaggcataatgagctaatatgtgtaaagtgcttggaacagcgcctggtacataccaagtgctgtgtgttatctattattagtcaacaaataaacattgaacaccaatccatgcctagcaatgttctcaatgctggggctgcaagtagacagagtggctcatggaggtaacctcaaggacagagtccaccctttgttttattttgcagaattgatcgacatctctctctaacactccctgtttgtgtgaccttgggtgagtcacgtaatctgactgtaccctaggtttctcattgaccagtgcctgcccctctaggctttgggcagggctagagatagtgtggatcaagtgcttagaaccaaagccttctcagtaaatggtggttagttttgttcatgctaatttttccaggaccagtggtggttcctctactccaggtctgtggctagaaaaaaacacatttcatcttttcccatactaccacctcactcctcaccacaatcctgtgaggcaggcatcacaatactgaactttacagattaagagacattgcacagagaggttaagcaacctacccaaggtcacggtgttttcaagtggcagagctgaggtttgaccccaagtctgttggatgccactacctgtgctcctggctactaagccacactcctctccatgggaaccacacctgagagccaggacaaagccttgcacttccaggaatcatttgaaaatgtggattcttgaggcttggtctagagtgtttgtcaagagccgcatctatgcaccttctctctggtgcacccaatggctccacattcctgggacctcctggtccttttcttttcccccactcagtctatggccatgaatccacattcatacccaggcctctcaaaagacagcagaggagagctgagtgattggaagaaagcatgaacaccaatgccaatgcatggcatgatgacaaagcaaacacacatgtgctaactacggggcaggcaccgtcctaagtgccttctgtgtattatctcatttaatcctctcaacaacccatgagaaaagtactctcattaccccaaattgtaaggtgaggagatggagacacagagtggtagagtgacttactccaggtcacgcagcgagtcaggattcaaagctgggcagctaggctctagagtccatgccccactgtctttgtcatccacgctattcatgcaggccctagcagtgggggctgaagaatgcatgggaaaggttccctgcaaaatgaaagaccttcctagaagccagcaggtagtcatggtgactatagatggctcttcccaaaccaggattgtgggccacaccacacccagccattggcatttcctgagccagtgtaactgttaaatgatgcagctgtgggaatgaggaagaagccctggccccccgtcccaaatttgcaggtgggtagacagttatttccttccttattctcaccttgccctcactaccatcaaaaaacacgtctccttacattgttggcaattggcagaagggacagatactgagggctttggttgattgtgatgcatccattaaaatgtaccagcttgctgagccacagatcacttctgcaggccttgtctccactgatagggtgcatgcacgtgtgcgtgcgtgcgtgtgtgtgtgtgtgtgtgtgtgtgcgtgcgtttggcaaaatgggactgtttctgcttagaccttggtgagaatccaaggggctcactccaggaatttgaacccactgggcactcacccattcaggtggatgccaccccacttcttccatggcaggatcatccctgagcacctgacggccccagctcactcactgacttgcacactctctcctttggggccctttcctcaccagaccttgcttacaaaccagggactcacagcccagaatcggcctgtcaacacgctctatttgactaacactgaacgtttttaattaaaactatgtttttaattaaatcaatgacaaattattgaaaaccaggagattttacaaacaaatctatacgtttggctttgctttaaaaagctgaagatgtggcttttataccggttattcccaaattgtaggaaacagccaccataaataatggctggatttaaaccagggaatgacctcttccttccctcaccatccacaccactctgtattgtctgaaatgatatcggtgagaactacttttggctccatgcaacaaaaacccaaagtgagtatgtcttaaactagataagagtttatttttctttctcctaagagtcccaggtagcctgtctaaaggacagagggtgctccttggtgtcagggactcaagctccttccctcttgatgttccactgtgcatggcttccattctgaaggtcaccttaaagtttaagaaggctgcaccagctccagccattacatctacattccagctaggaggaagcaggaagaaaaaaaggacacaccccctcctataagaaccctttaggaatttgtgtgtaacacacctacttacatccctctgccagaacttagtcacatggccacctgctgcaatggtaactgggaagtgtagtctctattttgggcaaccatgtgtccaggaaactatcatagtaactattactatgaaaagaagcatagctgctgaattgtttaacttctttacacaggctgtaagcccgtgaagatgaaactttgtctttgactttggctctgagcttctgctacttcattaaaaatttatgtactgttgttcctctcattaagttgttccaaggaattcactaggagatgacgaatgtaagtatgtctagcaaagttttggtacttaatataagctcagcgattgtgcatttgtttcatctattctacaccagatgttacttgtctcccctttgtcaggactttgctcctcagtgaagcctccctgacctcccagcaatttcaaattttaaatagaagcgccccctccactcccagcactccctatccctgtcctgtctttctttttctaaatacacctgtaatcaccgacctgctatatttttcaaaggttactttgtttaccgtctgtgtccctcaactaaaatacgagttctatgaggtcagtggttttggtttctattgttcacagctgtatccctagcacctaggatagaccctggtacatagtaggtactcagtaacgatatgttggatgcatgaatgaccagatagctattgccttctcagagctgggtactgtgctcagtgtgagagacagaaccggaagcaagatatcttctagtttccatctccccatggcactgagcccagagcagaacacgctaagataaatacctattaccttggatcggatcttggtgccagcaggagtccaggcattttaattttgttttgacaaaggggctgataggagaagctggctggctcctctgtctctcatctgctggcagccctgggcaccctggcctgaccttccccgccttcagcaccacgtagcgcaggacagtcaaacataattggcctgccctactttttaagagaacccagattgaaggactgggcttttggtgggctgacctgtttaagagccttaagaggaagctcggagtttcaattttccactgccaaagcaaagctgtttttagctccgctttgatgaagcggcgggagtcaggtttggccccgggtcatccatcagctgacctggttgggaaaggcctcctgtgggggccccaggcctaaccacagcttcgcaaggaatgctcaggtttgctttgcccaactggagtcatcggtcctgctctgaagctgcccctggtccatcccaaaagacagacagtgagagagagatctccagccattctcaaatattttatcttgttgatgggcccctggacttgagttcctgcccaattcctccaggagttagctgcgtgacctcagacaaattgcttggcctccctgggcctcagtttcctaatctgttcagtgaggtttatcattctgatctcaatgggtggttgtaggtactaaatgatgtaatgccggttgactgctgtgtccatctcaggctttgaggatatttcacctggaccctctccctgcaggaaactgggctgattgacatccacgcgggtaggccaagtcagctcagagctttctctctgaattgcagtgctctggcatgctgcctgcttttctaggggtcaagcaccatctctttgaacctcttttctgatcgttttgtcaaactgtggtggaagagtttggcgtcgggggctctggccctatattggagggacccatatgatgcattcttgctggagtttgcttccagggaaaacatggtccctgcagacaaaagggtctgcccttggtcaccagaagcagaggcaggttgtgcaccaggcctccatgttgctgtagagccacagtctgatgcctcgatgaccccagagcctccactcactctgcctgccctttatgactctctctccagcctgaaagagtttgtttctgttctgccactgattgattgtgtgaccttgcagaagcctcggcctctctgtgtgctacacccacctcaaacagcaactagcctgtgagttaagggcactgtcttcatccatttggaaagctgtaataaaataccataaaccaggtggtttatgaacaatagacattcatttctcacagctctggagaccgggaagcccaaggtcaaggcagattccaggttggctgggggcccactacttggcacatggagccctctcaccccatgagccagaaagtggctgtgtcctcccatgctggaagagaccaggcagctctctggggcctcttttgtgggggtgctcatcccaccgtaatcgcctcccaaaagcccctccttctaatacaattccattggtaattaggtttcaatatctgaatttgaggaggacacagacatttggaccgtagcaggtatcagctctggagcctggctgcagggttcaggacccagctttgacactctctggttgagtaacttcagccaacaagttgtaagcaacatccctgtgactcagtttcctcctctgtgagggccgggtgacaataacaacacctacttcatgggagtgttgtgaaattgagttttacagatggggaaactgaggcattaacttgtcccagatcactcaactacagcatgttacagctgggtggttctggcccatgggaaggtctagagaggttattagctattattgttcttattgcaaaaggctttccctgagaattgaatgagatcagttttcagtgcctcgcacagggtctcgcacacaggaggtgctcagtgaacctctcactggtacactgatgaacgaggcctgcatcggctcctggaactcaagggcgagggacctgatgctgaccttgcccacagtaggggcacagccatgttcattgaaaaaagatcatagaaacaacaggttgaggaagtccgggaaacccagaggcagccaccttccacgcccgtcttccctcttctggtggaggcaggcttggttccaacaggcttggggccttcctgatgccagctctcacccaccaccaagtagagaggcagaggcagagattcctgttaaataaagcaatcacgaacgataggaaggaggcggcgagctcagccacgggcccagccttccaagtttgctcactgcccagcttctttggtctcatttccctttggccaaccacctggctcctggttccccaccacacggagtctttttctgaagagcacgtgccccacgccccctgcctgccagtcctgggatggcgtcgggtgaaggtaggaaaaacactctgaaccctgggccctcccgcccctgcccacccctgaacccagagcctgagtccaacaggctgaccagtgaggggctaagtggatcagtcaggacctggaggaggaagtggtttccatggcagcagccagagtctggaaaagaggcctggagaggaagccggtggagaagagcgggagatgtcggaatgggtgaaggggagcgggaagcgatgggccaggaagtcaggggaaggggtcagccagtgaaagatggagggtgggaatggggaagcgggttcagggcccaaggtgaacagcagtggctggacagggcaggaaagagcggtcgggaccagcgaccccatatctgtcaccacccaagggcctgtcactgacttcctggcttggatgatctaggatcccaagctaagctctctctggtttttcttggggtaattcaacattggaaaagaaaacctgatttctcagaggtgctttctcacattggaaaaaggttcctaccagtttgcccactggtaaatcatgactggcaggtctggggtgtccctctagtcaggagtaagggagctttccatggtgaccttgtcctgtcccagcttcaccacccagggcctcaggacaaagggcttgaggtgcagaagctgaagctgagagccgatgacctgcctgaggtcacacagtcctgggaggtagagcagagtgtggtgagccccacccgtccagcaccaaaagtccccttgcagtgtgaagatagaactgagaaagatgtggctcaaacatggcccagtgtgagtcaagagttgtcccctcgttctcacccttcaaggtcagcaggaggaaatggccaaggagctaaggcagctgggccgccaacgatcaggccaatttaagagacgtctatggcaggggtggagcctgagaggggtcccaggctccctgaagcgggtgaggggagggcttagggagggagctgggggcagggcggagagggcatcggctggagtattctggaacttctcccctctgtgcctactttctttggtacccctcctagccagccctgcattccagtggatgccacagatattttgtacccaatgagcaactgtatgacagaaaccattttcaggttggggggcggtgaaaatcatactaatggctttttaaaggccctgaagaaaaagatttcaggcagccttggaattggcgaaaacacataaggaggaaggtcataaaattcccagtgtccaggggctcagctcttaggtagtggggcttttccggaggctccaggccccctgtccagcgctgccccatccctgcctctctccccggtcccactcccccatcccactcccaggctgtacaacctgggagaccttccatctgtgctgagtgttctcagggaagcccaccacattaagaatggccgggctcctgactggctccccagccagaggaatggctggaaggtggcaggagaccccaggcagtgggctcccagccccatggaatgattcggccgtgtcttttccctgtttggctgggggagaagttggacccaaattctcctgcgttgtgtggtgaaaagagcaccatgtatttctggctcattgagataccttgactcattaagacttctggctcacagcagccacagctgcctatcactgagcacgtactccacatccgcctctggatggatgcataggctttgtaacaagatggccggatcgccaagcctccccaaccgcctgcagggggcggtcatgagcccccatttcccagaacctttgacggatcacctggtccaggtggcccggccgcttcttcccagatctgctgctgattgctgcctggccttgcataaatcacctccctgtctttagttttcttgactggacaaaccaggactagctggtcaccctggttaagaccagactcttctgggagagctattaaaggaatggagcttctccatgtacattctgtgctcacaagacaggtcccttagctcaagggagggtctcctgtgtccccctgcttttctgcttggtgctgtccaatggccccacccctcccggaggaagtgtgtccctactgtgtccctggaaagggcctgatggaggagaaaacccagggcttggccaaaaggagggtagggagtcatttcaggatttcgggttattccgtcttcggtatccttggagctgaaacttcgccttcacaggcaggtccccaggaatatattgacaccattgttaaggtgtccttagtcaagttcacagcagggaggatgagacaatttgctcttgagctaggcctggagtctgggtcccactttctgggctgagctcgagtgtagacccacctccaccaggcagggaaagacagagagtgcatcgccatctctttcagaagccggaggacaggaagcaggtacagagcaggggctgggagagcagagcaaggctcagcattcggttagtgcaggggccatgtctgtgtgtgtacagctttctggcagcccctggtgtttgaaagaacccctgtcctcaaggaatgtccattcaacgatattcattaggcagctgccctgtgtcaaaaacatccaagcactaggctctggtatttgaggtttggtgaagccaatggaaggagaccacccagtgtgtctgcggtggggcagggcaagggtaaacagatggatggactgagggggagggagaaggactgaggccctgagtcttcgagcgggcttgtctgaccagcagcagcggtacctggtggctggttagaaattctcagggccccggaatgattctgccatgcctctttcctatgtggctgggggaaaaattagaccacaactccccagcattgtttggtgaaaagaacatcagctatttttgattcattgagactccaactgtaggctcaccataatctgcgctggaaccaaatcctcaggggattcttgtacatcccagaacccccctggggtctcctgtaagggaccccaccccaccacaaggtctagggaggccctttcctgcctgtctccatctgttttcccaggtctgccagctaccacaaatgctacccccagtagctaatctattccccagtcctgggaggtttgtgctctcacccagggactgtgatggaaaagcaagatgccgtgagggcagccggggataggcagcagccagggctggctgagcaggtgcacacctgggtcactaggccaagctaactgacctgagccacccacagctcccagccacctctgccaattacacaggtgtgaggaggtggggggaagagcagagacctcttccccgcccatgccccccccttttttttccagggagtagcaaaccttttccatgtgtcttattagcaaacatccctctagtacccagagtggccagacactttatcgccagttttattagctctgcctcacggctctgtccaggtggagcaggcattctgcaaatgttgcccccatatcacagggcatgaccctgaacttggagaatgagcaggtgttggagggagtgagaaacaaggcccaggcctcagggaagaagcagcccatcagggatgcatggcaggcgcagaaacagtaaaacttcattacttcatgcttgggatctttccagcaggaatgagggagggcagagcccaggcaggcacttggctcataagattgcagggggtgtgtttaacctacttgcaggaacaactctgtccccagccctttagaagcttggtttccatgcaaacaatggttatacaaatgaaaagcctctctcatctcttcattaaagcacagcctcaaaggacccatcactacctgaatcttctctgttagcccagaatgagatactgtgtatataaatgaagacgtttgaattacaaaatgctttttaaatcgggtagattatgaaagtttggtcctgaagagtcttctccttcagttgctgaattttggcaaggatgcaaaaccacacaccacgttcctccctccatctgtccctcccttcctcctgtctgggtctgggccacatctgagtttgcagtcagactgaatttgggcttgctcccgtagtcgatggaagctgcaggaagggtttatgttgggaaaggacaggccagatcttcgctgtcataaggtcactctgacagcagggtgggggcctcaggcagggagatggtggcaagaatgaagacaaaaatggagaggttctgggccaagcaagacagtggggtggaggcgaggaaacatcgatgagcctcctgtgccacaacatcctctaatctgggcgaagattaaaagaaaagagggtcaggggcacccaggcaaatgtcatgcacccttttctcatagagaaatcctgtagctccccattcttcctctccaagccttttgatccacgttgcacacacaattccaacaggacttgttatttgaagctcactgcaaattgacagcaacacttagaaagtaggaataggttggcggggaggggcatgaggggcaacatggagtgagctgcttctagaagaaggcactgagcagtgtgggcaaaaagacaaaaactcatgaaaaaccaagaagccatcatgcagccactttagaagacatttgagcagtgtcttataaagttaggtataggaccagccgtgccatgtcctcatttgcacacacagcacctctccctgggctaacagagacgatccaggtagctgccaggcctttgaggctctgttttaatgaagagagagccatccaggtgtccatcaacaggaggatgggtaagtaaatggtgtgtagccacgaaatgcgatgctgttcagtaggaaaagggacgcaacaattggtgaaggcaacaacatgaatgaatctcaaaataatgacaaggagtggaagaaaccaagcaaaacatagtacacactttgtgattccatttatataaaatcctaggaatcatgatttatagtgacagaaagaggatcaatggctgcctgaggatgaggggcatagattataaaagggcacaaggagctttttgggagagatgagtatgttcattatcttgattgtggcaatggtctcaatacattgaaacttatcaaatgtggaaatgctgagtaggtacaatttattgtttgtcaattataccccaataaagcaattaataaaattgaaacaaacaaaggcaaggatcccaggagacatttagcatcaggataaactcacctaacacattgcaaaacccctaagactcgacaggatgagattgatgtttgttttaatgaccttgatcctgggacaggttaattaacgtccagcctcctccctctaagaagtagacggatgtagactggaggcagattccagagaaaaggtgtctttatagtgtggtcatttaaaagtatagatgttcccggacttatgatgggattacgtcccaataagtccatcgtaagttcaaaatatcttaggtcgaaaatgcacttaaaacatctgatctacagaacatcatggcttagcgcctaacctagcttaaatgtgcggaaaacactttcattagcctacactcgggcaaaataatccaacacaaagcccattttgtaataaagagctgagtatctcatggaatgtattaaataccatactgaaattgaaccatggaatggttgtatggctactcaaagtctggtttctactgagtgtgtatgactttcacgctgtcttaagtaaaaaaatcgtaagttgaaccattgtgagtcggggaccttctgtattgttttgtctgtcttgttcccttatatatactcaacaccacaagcggtgcatggtacatggtgggtgcttaacgatttgttttaaaattttcatcaattaacagtgtaaggagaagaatatgacaagcactcccagcatgccaggccctgttgtaagtgcactggtatgtgttcattcattcaggcttcagttctcagcaaaagtcaaatattggatcacttggttcttcaacagcacaggaaaagcaaatcaaactcatttcctgtgtcctcacagctccaccctcccctccagtgtctccattctatgaaaatctaggattcttcccagtggaaaggcaaaaccaggaaaggaaagctaagcagaggctgtaaactcgtgtggggcgtggagaatgtgcacaggacttgctcagcaaacctcagtcatcagaattaaggggcccgccagaagcttggagcaggaaatttaggaaaataaaaggccatcctgtttcttccagcagggagaaaacatatggctctcattacctagagaggtggcaagcctcagaatagagacacgctcaagagtgatggaggcaaattcagagaccagagagctcaaatcaatttgctgataaaggaagatctgggggcagtgggggagagcattcatgggctccagcctccatctggcttgaattcaaatcatgccacctactcactctatgtagcaaagattcagttagagagggtaaaatgctcagtgcagtgcctcctactgtaaatctttatacatattggcacctccccagatgctgtaatccacaagacaggtgtcatagcacccatgtatcagatggagaaaccgaagctcaaagaagccaaaggacctcatccaacatcacatgctagtcaggtgcagagccaagactagagcccagggctcttgactcctggtgcagactgtttccactaacctcattcatacaggtgatactccttgagcacctaccaagtgaccaggcttccctccttgcctgggagggaaaagaaacaagttatactgcagcatgacatggacaggtatgtgctcccagagacagatgcagccctggagaggtggagatgaattatgtctttggagggctgggcagtcaaggtagcctgcctggtggaggtggcatctgaatgtagagcctatagagcttaacattataggcacaagcatggaggcagggaccaaaacctctagcatccgtgtacccactcccaatccaagcctcagtttagggcatggcatacttctgttgaaggtggatggcccacagccctggctccagattcagcagaagctgcagtgcccagcgcttgcatggccttacctagtgaaggcatgcaggtcacggggcatgcagcatccgccctcgctgtgcctggcttttcaaaaacacaattactcacccttcagagatgccgtcggtgttggtaaactccagccgctaaactgcattacactgatctctccagaaacctttgcagttattaatagtttattgatcacagcccattgctgatgagagcaggcctcctcaccctcacccccctcgggtccctgctatctgtggaaagccttctattcatcatgcagatcaatgccactcaattctggggaaagggagtctctgggccacttaatccactttagaaagaaaacagaaaagaccaaattttagatgaggtgctgagaagagatggattggtcaaaatcaaagctgtgacctggcagctgtttggtctgccaatgagaactagaatctgccttggttggaagtggggggatcctggccatgtcagatggtaacaggggaaaccaggtgaggggtgtacagcgatctctgttatatttgcaaatcttctgtgattctaaacttatccaaaatacaaattttatttttttagaaaataacttggctcatgggaggaatggaaagaatgccactgtagctggaggaaggggcaggggcgagagagaagggaaggtgggagacatggctggaggaaggggcaggggcgtgggagaagggaaggtgggagacatggctggaggaaggggcaggggcgtgggagaagggaaggtgggagacatggctggaggaaggggcagggacatgggataagggaaggtggaagacatagctagagatgtagaaggaaaaagtgtgctgggccctgttggccaagatgatgattcttatctctctttttgccattttttattgataaactttattttttagagcagcttaaggttcacagcaaaactgagcagaaagtacagaaagttcccacctgcccctgtcccacacatgtacaacctctgccaccattgacttcctacacttcagtgacacatttgttaccatcaattaacctacatggatacatcgttaccacccgaaatccgtagttcacagtagggttcacttctggtgttctgcatttactaggttttggcacatgttactaccttttgaaatatttttatcgaattgatattgctgtttcatattttaagatttacagttttatttctatttaggagatttttatattctccattttattttattttatttccataggttattggggaacaggtagtgtttggttacataagttctttagtggtgatttgtgagatttaggtgcgcccatcacccgagcagtatgccctatcccaatttgtagtcttttatctctcaccccctcccaccttttcccccaaattcccaaagtttattgtatcattcttatgcctttgcatcctcctagcttagctcccacttatgcatgagaacatacaatgtttggttttccgttcttgagttacttcccttagaataggggtctccaattccatccaggttgctgtgaatgccattattttgttcctttttatggctgaatagtattccacggtatagatatataccacagttttttaatccactcattgattaatgggcatttgagctggttccgtatttttgcaattgcaaattgtgctgctataaacatgcgtgtgcaagtatccttttcatataatgtctttgtcataaaagcagagagagcctttgttgggacttaggtaagggagtaccattcatctcatttgcatttgaaaagatctagattctacctggagaatggatcaggagggagattaccagggatagaaagcccagtaaacctctgcctccatattccaggtgagaagagatgctgactgtggagatggagggaagtggatagttcaggatctattaggagtagaacacccaggacttggtcgctgtctgtatttggagggtgtggaagtgggagatgtcaaggagggtgcccaagagtgtgccttgggctaatggtggaggacaggtctggacattcaaggaactagggaacctgggcttgctccttcaatcgatggtagaaggagcatctggggctgtacacatagtcctcagtgagaagctgcctttttcataaagcagcaatcccggtgtaccccgagctgtcttctataccacctgtgagatgtcacctacatgtgtcacccaagcatattgcttacgttactatcacctgagcatgtcatcagggtagcagttgcctaaacatgacacctgtgtcgctatcctataaacacatcttctgcagccatcacctaggtggtggttacctgcacgtatctgcctgggtgtcaaccatgttattattatcttattacctcacctggagagctgccagctacacatgtctcctgagcctgtttctttacagagctgtcacctgaacctgccacctgaactcctttcacctacaaaagtcatttaagcaggttgtctttataaccaacacctatgagtgtcaccaagtgcaaattctgctcctactgtttgtaagccatggggtcttgggtaagtcatgccatctctctctgagtctcttttttttttttttatctaaaatatgtcactccaggtgactgtcactcagtaatggcgcctggtagagaggctattttttcagtctagctgagttacaaacaaagaaaatcattcccagaggggagactggtcccctgctgttcccatgtcactgcgctctttattctgagatcagggagtggagggggacggcgtcttctcaacaaagtccccctgatgaaaagcttcccattctttaagtccttccatgacagtcggtagaccagatgtcaacctctgtgtgttctatgtaaatgaaggtgtttgtttatgctaatgtgtgctgggtggtgggagggatgggctggctcagctcactaagacgacagtgatggaaaaagaggctggcagcccaggtgtggggggacagtgagtcacaggggaaaaggagccagaagacgaagatggagcaggtagctaaaaggagagaagaaaagagcgaagctgaggttatgttgctctgcaaaagcaggtgggagagcaaagtgggaagtgtgtccaggaggctgaagggaggataagaactggattgaaagaacctccattctcaggggtggcagatgggtcacacgcccaagagcctgagcgccaaccaactgctgctcttttgtgtccccagtggggtccttgtcaggcaggttagtcaggtaagtccatgggtatggatcccttcccatagttttctgctatgacttgagaacttctaagacttaaacagaaccccagtccctctaagttgtagccagaataggctggaactcgcatgaagacagacatatttccccaatgcagcaatgacatagcctctgcaactccaggccaaggctccttcccatccaagtgtccagattccacttgccaggaattcgctctccccacagagcttcgcaggacccaggaaaaacacaaaatggcccctctatccatttggtgcaatgttcctgcttacaaaagtcctgcagggacatcattgcatttaatcttcactgcagtcacaggaagtagcatctccactgtttaggaaagaaaatggagtctccaggagagatggactgacttagccaaggtcccatgatttacaaacagtaggagcagaattggaacctggttctctttgactccatgtcaaggctcttttcaatatagaagggaggaaagagcctccctgcttgcattttccatggggagacagagcaacataccaactcattttcacatggtctgaccctatagatgctatggaaagatccagaacaggagccatccaactacagcctgcaggccaaatctagctcatcgcctatttttttacaacttgtgaactgagaatgctttttatactttgaaatggttggagaaaaaaacagaagaaggatattgtatggcaaatgaaaattatgtgaaattcaaatttaaatgatcataagtaaagttttattggagcacagttgcaccaatttgtttacacaccgattgtagctgcttttgtgctgcaaggacagggttgaattgcaattgtaaagggcaagaaagcctaaaatatttactctctggacttttaggagaaaagactgaaagcaggtttgagggggtctctcccatccttagggatcacctcttctgagacaccctcccaactacctcagaggtggaagtggctgctccccaacctgagctcagataagctcacgcttttccatgtgagtgtggaacccagatcagcttctctacctccttgtctactgggatgggggctcctttgggacctgaattttattgtctttctcttccatgatctcaggactgggcatgaagtggcagcatggcggcatggagagagaaattcaaatttccatactggttcttattagcaattgagttccgtcctgagcctcagtttccttgtttatgaaatgggaatatggaccctatgtggaggccgtcatgaggaaagagggagccgatgcctccagtgacagttttggtcccatactgcatgcagcgacatactaaatgcccatacctcttcacctgtgccatcctcacggctccctggaagtgggcaccatcccaggctcatggaagccaacaggctaaataactgctccaggacccactgagcacaaattgggctctggctgaacacagtccacaccttcactgtctgagatgccgagcacagggtctgcatacagtcggtgttccataaatgctcccctcctcccagcccagcacacaggcctgtgtttgttagtggaggctgcaccagtgggcatcaggatgagtttccttgaacgctgcctcacccagccccacgatgaagggccctcaccctgtcttctgcctcccccaggctgcccgaggtccggatctcagacaatggtccctatgagtgccatgtgggcatctacgaccgcgccaccagggagaaggtggtcctggcatcaggcaacatcttcctcaacgtcatgggtgagtgcagggccactggcccctggtgtctcagtgaggaggacgagtatgcttgagtgtgtgaatgtgcgcacagagtggccatcctgggggccatccaccagaagttctgttgtgctggtgtcttccctttcctgctcttgttgtggaggggcaaccagaccaagctgagccaaggtgtgacccgtgaagtcttgccccccatgggcctcccctcaggaggtccccttctcagcacaggtaccccaacaggaccctccccagggagtgaaggatagcacctcagccgagatgcacacctgctgcagagggaactattctgcccctcagccaaaagattctcctgcacctcctgaggccttaatggagagggcataggatctggagatgaattagaaagcgctcatggctgggattcagagctcctgggttctcaccctctccccatgcctccatttatgcacatgtaaaatggaggtaataatactggtgtctgtctctagctggctgggtccttgggtaagtctatccccatcccagactcagttttcccatgtgtaaaacaagaatgctgctctgcacgttctcagaagcccccactggctctaatgttcttgtcagatacacacctttggattctggctctattgcaaggatgctggggacttggccttgactccagactctgtgttctccggttttcttatcaaataatacgtatcagggaaacaaagcttgcggtacacaggcaatcgatgaaagcataaaggccctgctgaaagccgccgcttctggggaaattgaaaacctccaaaggccagacctccagagggacattgattcctgcagcacacccgtggtggttctggcttcccgatggagccacaatgcaggaggtggcattgccaggaaaagcccctctctcgcagttactcatgcaccactcagctcctctgataaaggaactagcagcgtttgggtgcctggccctgggttggccacaccagggaacctaggagggacagaactcagtttgcaccatcaaggaactccaagtctgatgagagacatgtacttaaccaatcatttatgcatcacaatgtactgagcacctacctatgaggtggccgggaatggacccaaactttttataggaaaaatgcttatctgtagagattttgcaggagacaagcataaaacacatgcatagatgaatcaaaaagagcctgcaacatgctggaaggaaataaagcagagtaaagggataaagagtgactgcaggtgggtggctgctagcatagggaggggactcagggaaggcccctctgcagctattgggctgagtgctttacatgtgttatgtcatttagtcctcacaaccaatccaagggtacgtgctagcattaagtccattttgcagatgcagaaatggatcacagagaaagcaagcaacttgcctaaagtcacacagccaagatcacaaaatcctcctatgatatcaggcagctcagtgttgggccaggacccaggcatcttgactccaaggccagctctgtcgcattgctggaggcagtgaagacactgcgctaaggcctcaatctaaggtgccttcaagcaaggccagagtccttaaaaaccatccctccatgaggcccacacttcctattacttcaccaaagaaccctgagcaggttattctcctactgtggcctcaatttcccccatctgtactgtattagtccattttcatgttgctgataaagacatacccaagactgggcaatttgcaaaagaaagaggtttaatggaatcacagttccacgtggctagggaggcctcacaatcgcggtggaaggtgaaagacacatctcacatggtggaagacaagagaacttgtgcagggaaactcccctttatgaaatcatcagatcttgtgagacttattcactatcatgagaaatagcacaggaaagaccgacccctatgattcagttatctcccactaggtccctcctacaacacatgggaattgtgggagctacagtataagatgagatttgagttgggacacagccaaaccatatcatgtatcatcagagggttgaccagaccatcctacactccctcccagctctgacacttctgagtcccttactccatccactaggtgaggaaactgaggcacagagtgatctcgtgggactcactcaggttgcacaactggcctgatggtctctgctgagcaagggagtgtgctcctgtgggcctcaatttccccatctgtaaaacagggataaggatgcttccctcctagggtggctgtgaggcttaaagtagataaagtttgcagaacgcctacctcatcaagaatatcattgaagagctcagttacttggacactgttgtttttattatcactgtctctgatgtgcccactcctgggcacaactgtgtctgcctccctcttgcccctggttttggccccagcaaagagaagtcccccattcacagctccaaagagccctgcactagtctgaggaatgactgctctgggaacacagcttcacgcaccgtggcaacctggaagccagggtgtgtctctgggagtggcagagacaggggtctctccttactcaccttctctgggcttcttccccaaaggtctgcgtgtcctggcaccatgcacctatggaaggagccaggatatatcccaactgtcataatgatggcaatgccccacacttgcccaatctgagcaatttcagaggggctttcacattgaggacatcatccaatcctcactgcagatcggcgcgtgggggattactattatctctaactcacagatgaagagactgagacccagggaagggaatgaatttgctccaggccttatagggtgggggttatctctgtgccagaggagcgtggcttctgtagctcaccaaggtcctgaatggtgaggggagggccgggggaggcggcgtggctgagtgtttctcatacagcatctcctgtaacccatcgaccacatgggcctgggaggcaggcaccacaataagcccattgcacagacctggctcagaggggcatgggacttggccgaggttggagggttaaaggagataatctatagaacagaatgttctgggcctgaggcttggcacattctggatgatcaataaatagtatctcttaatgacaaatagtagtcgggtcagttacaaaccaggcacaattagaccaatctctgtgaacgtctccttcaaatatgtttcagggcaggtttcaaaaattaaaatcgactcattgctttggttcatctgtggcattgcattcacacacaaagaccctctcttcaaacgagcagaggtcactgaacattggggtctcttttgtgccacacgggaccctaagggccactgcagccaaactggggcaagacagaccctccccagtttggaggtcaatgggaagctcccaggacagtggggagaaggagagccgaggagctggggacggcccagggcccacctgcctcaaagcacagagcagttccaccagaaagcccagcaccccagtctaccatccacacgtccacatccagcacattctaacgcggccatttccagaggcctccgggtgaagatgaaaacgcgagtgcagctgtaatttcacgcctataacatcccactgtgtggtggggaaagacatttgggagtcccgtgggtgacaccaagggtgtatgctgcacacggtcattaaaatgtttttatccgagctgcagataaattgtaagccaatttgaaagttgcgtgctgggccccaggaacgcattatacacagtcatggaaggattttgaaggttcttctgggggtgcaggttaggggggagggagcgtgttaagggtgcgctgttacaatcaattagatgttgtgagagccaggcaccccactcccatccccaccgaagttaaaagactctgcacttctggctcctctggaatgccaaggggcagggtttctctgccaccgagtggggccctttcaacccaaagctaaaaagcaaggccaccctccgcgtgccagcattgagctcagtgttcaacccacagttaatacctcacaaaagcccttggatgtgggcctggtcatccccattttacggatgacggagcagaggctccgagagtttaaggggtacatccacgtgagtcacagagcagggtgggcaggagcggggcgtcccacctggtctgcctgagcccagagcacgtacttatacagcagccttaactcccaaaggaaatttccctccccttgacccaaaggccatgagtcacacaaacctcaaacaagcactggagtggagacagagtgcagggagtggggacttccttgagaccgagccctaactaggtggctcaaaaactccgatggtcctggcatggtggctcacatgtctaatcccagtacttccggaggctgaggtgggtggatctcttgagcccaggagttctagcccagcctgggcaacctggcgaaatcccgtttctacaaaacattagctgggctgtggtggtatgtgcctgtagtcccagctactcaggaggctgaggtgggaggattacttgagcctgggaggtaaaggctgcagtgagctgagatcacgccactgctttctagcctgggcaacagtgagaccctgtctccaaaaatgaaacaaaaccaaaccaataaaaccaaacaacaacaacgaattccgatggatgggtggggctgtttgcctttcggaacatgtaggagtctggaaggaacacagaatgtctgtgcccttgcctcccttcctgtccccatccccatttttggttctctcatccactgctatccagcacctcccccacttctcaaaccctctgaaaggagcactgaacttggagtccagcagacctgggtccaaatcccaattagtgtctacttttgacatggacggtctagtattgagtttcctttctggtaaaacagcatatcagaatgtcttttttgttcaaatatattataaggtgacttggatgcccacgtacatggacattctaatttgcatttattcatttgtgtgttcattcatttaacatatatttattgagcacctagtacattgcaggcactgttgtgtgcactggagtttccaatgaacaaggaggacaaaaaaaaaaccaaacaaacaaaaaactggtcctcacagacagtgcaataggggaggcagaagatgagcaagtgaagagatggggagacaaatgggatgtcagtgggtggtaaagcaatgtcaggaaaaacccatcagggatggggctgttctaggtcaacgtggcctctctgagaaggtaacattcaaaagaggtgagctatatggacttcattcattcatgtcagtgattcagtgacttactgagcattccccaggtgccaggcacaattctaggtgctgtggatacactgacaataagacaaggtccttgctccctggactcacattctctaagggaaatagcttcatggtacagaggacgaaactagtttctggggcttcccatagcaaattgctgcaaactgggtggcttaaaaccacagcaatgtattgtctcacagtgttagtcctagaagcctgaaatcaaggtgtcagtagggccatgctccccatgcaagggaaaaatccttccttgtccctctgcttgcctctggtgttgctggcaatccttggagttccctggcttatagatgcatcacaccgatctctgcctctctcatcatatggccttctctctctggctctgtgttcctgtccctgtgttcagatttgcttctgcttctgcccctgcttctgcttcttctccttctccttctccttctttcttctttcctcctcttctccgtcctcctccccctccccctccttcttctccttcttcttctccttcttcttctcctcctcctccttcttctcttcttcttcttcttcttcttcttcttcttcctcttcctcttcctcttcttcttcttcttcttctcctcctcctcctcctccttctcctcctccccctccttctccttcttcttctcttttttttttttgtgtgtgtgagacagtcttgctctgttgcccagggtggcctcaaatgcctgagttcaagcaatgcactcaccttggcctcccaaagtgctacaggcatgagacactgtgcccacctcaacagatttgctccttataaggacatcagtcattgaattaggactcaccctaatccagtgtgacctcatcttacctttagcacaattgcaaggaccctatttccaaataaggttacatttatacggactgtgggtcagaacttcaacacatcatcttcagggacataattcaacccacagcagtaactgagtcaggatgtagcacaccaagattccctgtctgactctgaagctgacactctctgctcccaaccccgtgggtcacccttcgttgggcactgactaatatgcaggcgctgtgctaaactcttcttgtgttaactcactgaacactcacaaaagctctgcaaggtgagtactatcactttctctttagcagatgaagaaattgagaggtaatgtcacttccctacatcacccagccagtgtgtggcagggcaggggtatatagccatcctgcatgttaacatctctgctcctccagaagtttaccaatgagtaggaagcccagactcataaagtattggtacacattaataaaatgttctatcttgggatccttgtctctcttctggaagcttccaagtgaggttggcagatgaagtagacttttggaacctgaggccagagtggcaacaaaccacaccatatgctttgcaagtctggagccaggaaacacagcttccaccccaaagaacagatgttaatgaactttacatgacgtttctggttggtttgtcttttttcagtatgttctactgatttttattaagtgtgcctggtgcattttccttgttttttttttttttgtttgtttgtttgtttgtttgctctgttttgttttgttttgtcttgagacagtcttgctctgtcccccaggctggagtgcagtggcatgatctcaactcactgcagcctctgcctccaaggctcaagagattctcctgcctcagcctcccaagtaactggggttacagacatacaccaccatgcctggctaatttttctagttttagtcgagacgaggtttctccatgttggctaggctggtcttgaactcctgacctcaagtgatcctcccgcctcggccccccaaagtgctgggattacaggcatgagccaccaagcccggccctttggtttttctaaaatatggttttattgagatacaattcctataacatgcaatccgctcatgtaaagtgtaaaaaacagtggttttaccatattcacagagttgtgcctctaccaccacaatcaattttagaacattttcatcgtcctccaaagaaaccctgtacccatcagcagttacacaccaccccacattgtccctcttctcctcagtcataggcagccacaaacaccctttctgtctctatagatttgctggttctggatatttaatatgaatgagattatacaatatgtggtcttttgtggctagtttctttcgctttgcataatgtcttcaaggttcatccatattgtagcaggtaccagtacttcattcattttcaatgctgaataatattccttcatatggatagatcgcgttttgtttatgcattcctcagtggatggaaatctgggttgtttccactttttggctattatgaacaatgctgctataaacattcacgtgcaagtttttgtgtgaatgtgtagtttcagttctcttgggtatgtatccttggagtagaactgctgagtcaaacaatgactctgcatttaaatttctgagaagcttccagacagttttccacagtggctgcactgtgttatattcccaccaactgcatatgagtcccaacttctccacatctttgtcgacacttgttactatctctctttttgaatatagccatcctagtggatcctagtgaatgtggagtgatgtctctttgtggctttgattggcatttccctcagggccaatgacactgtacgtcctttcctgtgcttcttggccatttggacatcttctttggagaaacatctactcagagcctttggtcattttcaatggccttatttttctttttatgattgagttgtaagagttctctatctgacctacatgtaagtcccttatcaggtgtatcatctgcatatttttctcccattgtgtagattgtctttttactttctccatggtgtcctttgaaggacaaaatgttttaatgtcaatgaaatccagtttatctattttttcttttgtcacttgtgcttttcgtgtctatttaaggaggctttgcctaactcaatctcacaacttactcctgtatttctcttctaggagtttgtatagttttagctcttacagttaagttgatgatgcatttcaagtttatttttatatatggtgtgagggaggggtccaacttcatcatttgcatgtggatgtctggttgtcccagcaccatttgtcgaacacactattctatccccattgaattatcttggcatccttgtcgaaaatcaattgactgtgaaagtgcgagtttatttccagactctccattctgtttcactgctctatatgtctatccctgtgcacgtctggtgcttttctaaccatctgccacctccagcctggctgttactctccagctatgtgactttaggcaatgagtttcacaggaagctctcctgttcagtttctcgacctttccccttaaaagaaacttaccctgggactggtgagggttcccagaggaaaagagggtacagaaggtcctgggggtaatgaaggctgagtctacttccaggaggcccagccagaaccttggatttctggagagctggattcttgctttctaagaccagattcttgaacgtgattctctggaatcccagcctggcactcccctctggaaaaagaagcaaatttccaggaccaataatcagagtgccaagaacttctctcttttcttttccactctgtcacccaggctggagtgcagtggtgcaaccatagctcactgcagcctcaacctcccaggctcaagcaatcctcctgcctcagcctccctagtagctgggactataggtgtgtgccaccatgcctggctaatttttaaaaatttttgtagacacagggtctcactctgttggtcaggctggaagaacctcttttgacttgggaagaagaatacactatacctccaagtgagctaaggagatctgagggctgagggcagacctcacccctctcagaggtctgctgatctcctgtaggcctgagcaaaacagaagtaacaccactctgcttctctgggggacagcaatgggaaagcagagttcagtttgcagaatcccctttcaagaaggctgtctgtgcacaggacagctgtgggggaagtggggcttcttccaagcaaagccgccatacaatggtgtgtatggtggtccaaggggcagggtaggtcagtggagggaggctgccagtctgagatccctgggaaatccccagaaaggcaagattcagagcctcagctacctcctttcccaggatgtctgctgggtggaaaatgatcagctccttcctctgtcttagagcctgagtggatgaaccacctgccagacttgggctaattacattaactggctccaggcgattactgtggccacagactccagggagccaggctgctgctccacaggggaagcgaggaggctgcagagggaggcatgggctggctgggatccaggccagagctgcagagaattcccagagcactgaaggggaggaggtatgaacacgagcttccacctcttaccccagaaacccccagggtctgaggaccaggctggggctactcttattccccaagcaaaagcctggacaagcccattcccaagccctctccctctgcctgcactccttcttaccagtctgggtgagtgacatgcagatgcccagcccctccaaactagaaaaggtggaggctagataatcccccactggagaatgatctctctagtaaattagcttgaccataaatggagtttaattccttagagagttgaggagtggctaagggtatgggctttggattcagacatgacttttctaccagcttctgcaactaatagtaataaaagtgtttaatgtttgcttgtttttttatttatttatttgagacagagtctcactctgtcgcctaggctggggtgcagtggtgcagtcttagctcaatgcaacctccgcctcctgagttcaagtcatccttgtgcctcagcctcctgagtagccaggattataggcgcgcactaccacgtccagctaatttttgtatttttagtagagacatgtttctccatgttggccaggctggtcttgaactcctgacctcagatgatccaactacttcggcctcccaagttgctaggattacaggtgtgagccaccgcacccggctatggttaatgtttattgagcatttactatataccagggactgttctgcttaacacctgctatatcatttataacagccttctaaggtcgattctgtgattactttatccattttacaaatgtgaaaactgaggggttataaaatgtgcccaaggacacagaactagaattcaaacccaggcaggctgcctgccaagcgcagggacccagccactatgctcccccacctctcactggaatgtggcttttgaaagtttatttcatttccctagacctcagtgtccctttttgctgaatgggggttacagtagcacctgttggggcatgaaatgtaacagacaagtgaagggctgtgtccatagctcacagtgagtgctctggaggaggaaagctgttcttacttcctacgtatttggcttcaaccctcaccctgtaaatgtcagtggagttgagggtagggtcagaactatgagaagtgacaatggccctgtgggagctctcaaagccaggcagtgacatctgtggcctcccaccctgggtgctggcaaaggtggtcaggaaagaggatgcagccagcagcccggagtccaatcacacgccctccactgtcttgctgtggcttttcctttccaagcctcagtttcctcttctggaaactgaaggtaatcatgctttttaccctatgggctgtctcaaggaatgaataagatggcacgtttgggcgtagaggaaatgcttggcccagatgctggcatcattgttaggacagggcaggaagttagaagaacagagacgataggagccaacttaggacaataaatgcagtggccggacataagaggcctttccaagcagaagccacaggacatggggaccaattggaaagatgggaacagatgtggagacacggcggacctggcactggatggagatggtcctctgagaaggttccaatgcaaccacgtgatctcactcagcagccagcgatcgcagaaaatgggccgttggggtggagaggccagggcctatggacctctacaggcctcctccctgccagccggagcttctgagaagggcagcagaatgagaagtggggggcctgagacagctggctgtgctgagctaccaaagctggctggagtgggggctgcagcccacaggactgaggcgggagtggtcaggggcccctgagctggatgtgagcatgttcagagacgggacactgtcgtcttgagtgcctggacctggtcagggagctggaggaaggacacccatgctgctcgcctgcctgccacggacctcccagccagctgaggtcaccggctgagcgccagttgagagaggggccagacagatgggtttggggctcggaggagcattttgaagctaactgggtcatctagcaagaacggtcacttcccagcatcagccccaaaggtccaagcctgctgactgcctcctggacaggcttctagaaccctccctccctccctctctgaacacagttctgcaaagaagtgcccttgaccatagcccaccctcacccaggaacaggcccagctcattccaccagctgtccctctaatccccctacagcctgcagggcagagcctgtggtgcctcagtgtgagtgcccacagaggtcaggagacatgcccactgtcccacagcagtgagtggcgctgagattggagctcaggtcttctgggaccagagcccttgacgttcccactccatgaagctgtcaggaaaacagagggacatccacctctctgagtgtgggacaatgtggtagccatatggacctctggatcaagggcctcccaacagtcctggaattcagtggggtggggatctgtatccccattttacagagaagaaaactgagtctgctaataaaaggaaggctagagtttgaatctaaatattctgattgccactctccttccgtggggatctgaggccctgagctcgggagggaagcgaggcctttgaaacctctgacccattattgtgactggatgaagcagacaacccagtcaagcagcacacagtttttggtgcatcttgtccctggggaatagagctagcagactgtcatcagcctctctccaagggaactcggagcctagagtggaaacagaccacttgctctttcgtttctcatgcttacaaatcctttgattcaagcaatatttgtgagcacctactgtgcacctgctgtggggggagcactgagagagtcccatctccctcaaggtagctatacaaattagaaattcattttgatataggacagccaggatacagtctaatagcaatgaatttttcagttataaggtaccaaatgttgctccaggcacttaaatatataaattcatttaatcctcacaatccttaggagatgggtatttctagtattcttattttaataaatgaagaaattgagacccagagaggttaagtaacttgcccaaggtcacacagtgagtaagtggcagcgtttgttttcaaaccctgattgcctagcttgggagcttctctacagcctctcaagagatggcccattgagccctcctgagccaactgaagggattcatctgcttctggaattatctaggcaggtgtctgaagccccctggggccctcaccaactccctggaccttctgtgtctcacataccagggctcccctcttgttccagagtcagatcagcttcagcctcccaggccccgccagagcaggcctgcaggtgcatcattaaaccttgacaagtgtgaggtcagtacgatgctttatcctctccacccctgggagctggatttagtggctccagcagaaggtaaacttcccctccctggaacaggccctttaattactagtgatatgtggctgttgaaactgcagtgcctcgggcccagtgatttaaggggcaggcaggaagtggaagttacaggtgttaacagctgtatcaggagctgggagagcagggatcacagcctgaggaggctatagctgcctctggaggaatgctgctcacaggcactcttagggagagagaggtgatcctactgcctcaggtacaggtacagaaagggagactgaggccaagatcacactgcaagtcggcttggtatgaagctcagcagccctgactttgctgccaacttgcagtgaatccctggactcagtttccccatctgcatatgagaagctcatgtgctgtagagaagctcccaagccaagcaatctgggtttgaaaaccaactctgaggcaggaagacttcactcactccctaggagcaataatcacaataattttcataacaaaagctagcactgattgagtgctcactgagtgccaggcattatactaagttctttaagagctttctttggtttaattctcataacagctactgaggtggtcattcttgttattcccatttttacagaagaggaaaccgaggctcagacagaagaagcaacttacccaagaccccgtgacttagggagtgaccaaatggagtgtccaagcccctctctctgaagccagagcttggcctctctgctctgggacttaaggtccagtgttggccctcaaggagtccatgaatgatgggtgagagagagaagggcacaggtttccagaattccagcagaagaaaaataaggatgatgggggaggactagggtgcaagctaagagatgaggaaggagggagtccttcctccagaggagggcatcaggaaggcttcatggaggaggtggcatggagctgggcctagcaggctggtgaagagataggacaggaggcgctgcaggcagaaggagctatataggcaacaatgaggggcagaaaagcatggcaagagggggcacccctgcatggcaggaacccaaggcatgagaaggggcagggagtaacatatcatccatcacaacagcactcaccacagcagcactcaccacagctgacatttattcatcacttggcaggtgccaggtgtgggtctacatactttacgtagtgctcacaagatccctagaaagtagatcttgtgatgatcccatttcactggtgaggaaactagccaagcgcagtgtgcctcattcctgtaatcctagcactttggaaggccgatatgggatgatctcttgagcccagaagttcaagaccagcttggacaacatagggagaccccatctcttaaaaaaaaaaccactaaattacaaatataacaaatcacacgacgaaaatgaggtgcagcagggataagtggcttgccaaggttacccagctggtaggtgtccgaagcacgatacaatcgtcagccctggccctgagcccatggaaggtccactgctgtgcccagtcctgaggaagcagtgggtggtgaggaaagggccctcgctcctccaggctgtcatggtccctgctcacccactgtccacttggcttggccacaggcagagagggaaggagagaccctgaatccagtgccatccatccattggatatggggagcccatggccaggatgcctcaagagccagatgggccaggggactctccctgcagtagcctgtgggtggggagcaggagtgagggtggagagagtacttcctagggaacaaaagtgcattcgaggtcccaatacctgggtcagggcaaggccaagggaagaggcctcaggcactgggtctctgagacaccctcactctcaatcaagccctgccaccctggccagaagttgtgttcctttgggaatgaggccttgatctgcctcaccaagctctttacaaagatgcaatccaagagatattcaatcaagcaaacgcagttcaatgttcattgcagaacctgagtgatgggtgcatgaatgttcattgtacaattacttgaactgtttggtaggtttggaaatttgcagagtccaatgtcaaggggaaaaaaaatgcatccccctcccacaaaaaaaaatacccctcccacaaaacgcccttctctacagctcctccccactcacccacctcatctcccctggaaattgctttatgaggagcaagcggcaagaatgatttacttgctctctgactcgggaaatcaatcctaaaacgctgataggacaggaaagacgtggccacagagccccccgggaaatctcccgcttgaaggaaagctctgagccaggccaggagtgcggtggggggtaggggctctgcagggagatcggcaggcgtggcccagtggtgctgggagtggtccagagactgggagtggctcagagcactgacctgtggaaacacgtgaggacttcttaccactgccacatttagaggacacgtgggcccttcgacaccttgttctgcacctctaactgtctggatgaggaaaccgagacccagggagggggaaatgacggccatgtcgcagagaaagtccacggcaacgctgagacggaatcttcagccccctgactctcggttgacaccttttcccctgacacaataataaactaaaaaagccgtaacaactagaattgcctttctgctcgctaagtggcagtacttcattccccaccctcgcatgagacagccacccgtgccatcttcattctatgggtgggggggtaggggtgggcaggaagccatcagtggactcaaggacacaccgcttctaagcagaagggctgtgacctcgagccaggtttcccaggccctaggccttcaaggccagggctaagctctgttctaagcctcagaaagccaaggcctgtacacggttttcctggaagggacagaggttttgcacgctgggggaagatgaagaggggtctccccagagcctccaagtccagcccactgctctctggggggaggacggacgagcaacagcttataaggagctggtgctctgctactggccagttcttgaatgtgcctccctacctgcctccccaagcttccgtgggcttccagaggcttctctcacaaagctgcaagtatggtacctggtgaaatcgcccgtgtgtgtaatactcacctctcagatatattgaaaacatcccccaaattggctagctttgctgctatttaaaacagattcacgttacaccccatagatttcatctctgcagacacggcacctgtcgtggggcttaaacacattctctctattgctacataaactacagagcggaggcagttgcaggcagcggccacccacaggctgcggggcaggctgcttccagccagcaaaactccaggagcagagaggatctgcatgggcctagaggcctagggggccaatcagaaaactggagacattgacaagtagccgatcaagccgtaagtggaaagttgcaccggttgtggggagtggagctttggggatttgaagtcctttgatccaatcagcgtatagggccagggaggctccagagggttctctcctgtgcccctctgctgaggcctggggtagcctggctaaggttctccaattcccccaagcctttcgttttctatcagtaatcatcttcactcctgttgactgatcacctactatgaaccaagcccttagttcacataatttagtggttcttaggaccctaatttagagatgcaccaactgaagcttacatagattaaagcagcggtccacatatttgaacttggattagaatctcaggacttgttaaaactcagggtggggactgccggaccccaccccatcccaggttgggcaggtctggaatggggatcaaggatttgcgtttctaataagctcccgggtgattcggatgctggtggtccagggaacacacttggagaaccaccaggttaagggactagtcttgaaaatagtgctataatacaaatctagatccaacacaagacgtctgtggccgcccaccacccctttctttacaggtgtgtggcattttatttctccaccagcaatagcctcagttgggtccgctctgcccggcttcactgattcactgcctagaaggctgccttccctgtctgcagcacccccagagcagccagccagagcctccagttggggctgttaattttatcttctaccactgcgaaagcacaacagctggcaggggaggggcaaggcaggtgagcgggtgcttccaggcacctccctgcagagcagaggcggtgtgggtggatgacgcccgcagccactgggatccttcatgaacccgctccactcagaacggcccccatctcagattccggcaatgacctggaccccgggccccccacccctcgccactgcaccaagcacaggagctcccatggccgctttcaagtttgggggtggggctagattcagctcagcagctgccacataaaagggcccattgcagcccatataagcacagacgcagcgtttatctctcctgtcactgatggcggctccatttgggggctttttgttgttgcttttttttttcccttggctgctgttactactcagttcaatatttaattttcccataaaccaaagagttgcacttttttttccctctctctttttcttgccggggactcccttccactggtgggatctgtctcttcgggtctctgctgggagagaggggcttaggatggggctggagatttcagcccttccaacttgggcagggattggagggaaggatgcctgggcccttccctccaatccattcactcattcacttggaaaatacgtattgagcaaatcctggtgtgccaggctcttgggtgcggccgcaggtaagaagccttccctgacctcgtgttgcttacattctagtgagggtatcggaggaaaagagatgtgtgtgaaccaatatgtgagataattatacactgtgaggtgctctgtgaagaaaatatacaaaatgctggggccccaaacaaaagagagcttagcttagattgaggggtgacatttgagctgagacttcttgaaagtcctgacaaggctcagccaggctaaaaagctgagtgaaagacttcaaacaggggaagctgcacatgcaaaggccctgtggctggaaagagctgagtgtgttcatagactcaaagagaaaaatgtctcagtgtgtttggcgcatggtgatgggagggtaagtattggtcaaggtgtaagggttggagaagggagcaaggtctacagcactgcagggtcttctggaattttcttccacagatgggctatgtgctttcctgtgctgggagaaatgaaggaaacaaacagacattgaaattgaactcctattgcatggctggtcgacactagctctgaggctaggtggaagaaagacaaagctccaacttccagggaacacgcactctagtggggagacagacgttgacccagaacagaataacaagtagcaatgagtatgaaaagcacagggtgctccaggcacccagaggacaggctctaaccctgtctggaaaaacctgggaaggctgcctggaggaggcaacatctgaggccagccttaaaggatgaggtggagttaattagcagaaggcccagtgtgtgcagggcacagaggagatgagcaaagtgaagagggaaccacaggcagctcagcattgctgaagcagggagggcttcccagaggaggtgctcttttgagcaggttcttgaaggagcagagagacaggctagtggagatgatggggaagaaactaagatgtgtggaaccaaaagaaaaaaaaaagaaagaaattaaagtagggaatatggagggacatttatattcatggacacttttatattaaaaaggtggttttcttcttttgtgaaatatggtgtaatgactaagagctgattgaaaaggaaggcagtcaatagagcaggcatgctgagaggaaagaatgggtttttttgcaaacaatataattttgaacttgtctctcccctcccccatccctcccccaagcctaattgattaccaccccatgatgaatgacactgggagccagagtgtgctaagcaccttcgtagagtggtacccaatgagctggagagattttcccttcctcgagacaatggttactcctgggagggaaagaaattcccctatacattgttctcagccaagagaggggcgtgggccattggagagataatataattaaagctttcctgtttgctcagcactttgctatccttacagaaggtttatgtttgctttcctgtttgctcagcactttgctatccttacagaaggtttatgtttattttccatttgcttctcatctcaaaaaccctggaagctgagaggctggcagggtatgtcttattgaactcatttgatagatgggaagactgatgaccacaggcatcaactgatttgcccaaagttctatgggatgttgggagcagagcctgggctagaaccttggtctgactctattagagccagcaccctgggagaagtgggagcggacctcatggaagagtatttaactctagtactcacagtttgacacaggtttggggcagatttccctctccaacaattctgagatttatatcagatcaggtttgtgttcccaaatttcaaaggccacggaatgatttacagagcaaagaggagctgctgcattgtctccgaagtgagttacaatgaccaaaataacgttctgctttcaagataaagacaggcaatatttcggagttaatttcataaaaccgatcatccaaccattacctccctgtgtcgatgttaactgttgagtctaaaataacttcaactcctgcctcccttggtggccatggaacaggagtgatggaggttggctgtgacatacagctgtgttagatgggaagccactttacctttcccgatgctagaaaaaattattcatggaaacttctagcagcaattctctccccttaaggcacagtaaaaaaaaaaactagaaagtcaactggtttgattgggggtaggggcagagatcagtggatttaagggagttttatggtggtatccttggttgatcatcatggtggacttatagaatagggtcggcctttcctactgcccaggtctggtgttacacaagtggaataatgtgtctgtaagtggtttgtaaattatgaaactctgcccatgtctagactctttttttttttttttttttttttgagacggagtttcgctcttgttacccaggctgcagtgcaatggcacagtctcggctcactgcaacctccgccttccgggttcaagcgattctcctgcctcatccttctgagtagctgggattataagcatgtgtcaccacacccagctaattgcgtatttttagtagagagacggtttctccatgttggccaggctggtcttgaactcccgacctcacgtgatccactttcctcagcctcccagagtcctgggattacgggcatcagcccctgcacctggcctagattcttactattactaatacaattacgactactgtttattcttccccaagcaaaatatgcctgcttggtgtctcttcaccttagaagggtcatttcagatgaatggtgctgatgagtgtgatgagtgtgtttactcacccacccccaccacacacaccccagagagcattgcactgccacaggcatttcagaaaacacagcctcaaagtccacaaaaatgaggcactgatggtgggagcactggacatcattgtctacaggtgataacagaagagtgggagggagattggtgagccaggggtcttcgttgatgattctttgccacctggatctcctgtgaatacagtgggacacaggcaggtggcctcaccttacactgctcattctgttacctgactttgtatttgggattattctggcccaggaagtcatgtagagttgatatctgtgttcacagctgatctcccacctttgattgaacacttcctggggcatgggatctatcccaggcataggacacataaaaagctgctggcttttgaccttggccagagactgtaacagtgatgggaatggcgatgagaatggagatggtattggggttggggatgggatggaaatagaaatgagaattgagttggagatgaggatagagatgtgatagagattaagtgtggggacaggaatagaagtggtgataggaatggaggtgggatagagatgggggaggagatggagttgaagttggtcgtgagatggagacagaaatgaggagagaataggggatggagattgaggatggggagggatggaaatggagctgaatgtgaggatagagacagagatgagaatggagatggagtggagatggggatagaaataggaatggagatgaggatggggaaggggatgtggatgaggatgggatggagatagagatagaggtggagatgggcatggggtaaagataagaatagagaaggagattgagatcgagatggggaggagattgagatggggatggggataaagatgggggaagagatggagatggagatgggagtggggttggggatgggggtagatatgggtttggagatgaagatggggttggggatggtgataaaaacagggaaggagatggagatgaagatggagtggggatgagggtggaaatggggataaagataaggaaggagatgaagatggagatggggatggggatatggatgaattggggaaagggatggggatgaggatgagggtagggatgaggatggggatgggaacggagatgagggatgaggtgggcatggggatgggaatggagatgggggatgaggtggggatggggatgggaatgaagtggaggagcaggtggagagggggagtggggtgggaataggaatataaaaagggaagcctaagtgaaggaaggcttttattgggctatgaaactggcttttattgggctatgcaggcaggaatgccgtacttggtcaagagaagggaaaaagaaaaatagaaaagaagagggcgatgctaatagtgactagaagagtgaagcatctgtcaggagccagggactcctggatggagacggctccctgactgccggcactcagagccctccaccaggagacaggaggtgagatgcagagtgacattttcctaggactcactgatgggagtatattgatggggagggtgtgggaagcctgagctgtccgtgctgatgttaacagctctgctatgtcatcgtccatacaactgaaatctgttattgtcttatgagcttgattaactgtacatattgctaatataacgagggatggaaacacagctccagtcagggtctgtgtgggtggtgcgtgtgacttaggtgcagatctccagagagagagagagagtgtgtgtgtgtgtgtgtgaatgtttaggggggtgaagggtgtaagcgccatgctgtgcaaagaatcctagccaggatttggaaggctaggggccattccaggctctgccactgacttagggtatgattgtagccaaacctgtgcttctctctgatctcagtttgcttacttataaaatggaaagtctagaccagagttgtccaagagaaatataatgtaaagtacatatgtcactgtaagttttctaataaccgcattaagataagtttaaaaaagaaaaggtgaaattgattctagtaatatatttattaaacccaatatatccaaaatattatcatgtcaatatgttatcaatatatcttacgctcttcttaaaaaattaagacttctgttttacacttacagcacatgtgaacttgaacaaaccacatttcaggtgctccccagccacatggggtgagtggctgctctacgggacagcccgaatctagggcattttctgatctcctcactaaactgtgaatgctccaaaggtacgaccatgttttattctcccagtccttagcaaggaggctcaaataagaatgttagtaaatcacactgacaataagcacagctgatatgtattgggtgcactttcaaaacactttgcaggcactacgttactgaatcttcacaagtaccttacaattccatttttcagatcaggaaaccaggctcagagaggttaagtaacttgcccaaggtcacacagccagtaagtggtacagctgatctttgaaatctggctagtctgatctagaacccacctccttagccattgtcctgtactacctcccttatttatagtcatacactaattaaaattgctaccctgcattgcaggtaacttacatgtgccatcacatttactcttcaaagcaaacctcttagaagccaggcatagtggctcacacctgtaatcccaacactttgggaggctaagttgggaggatcgtttgaggccaggaattcaagaccagcttggacaatatagcaagaccctagctctacaaaacataaaaacaaaaacaaaaacaaaacaggcgtggtggcacacaactgtggtcccagctacttgagaggccgaggcaggacaattgatcacttgagcccaggaggtcaaggctgctgtgagccatgattgtgccagttcactccagcctgggtaacagagcgagaccctgcctcaaaaaacacaaaaaaaaaagaaaaagaaaagaaagaaagagagagagagaaagagaaagaaaaagaaagaaagaaagaaagaaagaaagaaagaaagaaagaaagaaaggaaggaaggaaggaaggaaggaaggaaggaaggaaggaaggaaggaaggaaggaaaagagaaagaaagaaagaaagggaaggaaggaaggaaggaaggaaggaaggaaggaaggaaggaaggaaggaaaagcaatcctctcctctcaggaaggttctaggtgtctgatctctgtttgctcagtgaagataagaaagaatgaatgagtgattttaaaggagtcgcctgcctggttctgagcctctaggattcttggaatgtatcctgatacctattcacctgccatcacgagccatgccagagttttatgctaagctctaactgcagaggtcactgatctttggggtaactgagtaactagagccacccacagcatcagttcctgatggaatttgattataaggcatccatggaaggtaagtgaatgttcctggtggttcaaatgtgtacatacacctaaaggcaccaatagatacaagctccctttttcttcccaaaggtcgaggtggctcagcttcatgtcagaggctgggctctggagtcagactgcctgagttcaaatcctggctcttcctcatactggcaccgtgagtgagtctgagcaagttgcttcacctcttaattttccccatctgtaaaatgggaataaataaacccagcctgtagactgatggtgaagacagaaagaatgcacacatgttaagaactcagaacaggtcctgattcctaagagttagccgttgtggattcttgtgtgggatccaggttttcggttgagttttggaaaggttagattgcagaatctgcaatttctaggtaattgacgtgttctgctgtatttttcccttctcggaattcctatccggcttaccatctgttttatgcgatcttacgcttaattacaattctccaactattgttctcccattgttttctgtgtgctctgcttctcttgctgacagcatgggttggctccctgaatgaatgaatgactcatacctgatttcatttcactaggccttgaaatagagttgcccgtgtgtctgtcgcccccacctgactgtgaactttgcaatgcttcacctgtttcatcattgggcacctcctggcagcacctggcattgttcccggcacctagtaggtgtcaggaaatgtttgtcgaatttaattaaacttaactagagtgaaaaccccctgaaggaaggaaaggcccatacctctttattttctctgcttccctccctgtgcgtgtcccaaggctgggtaaatcagaactgacagcttttcccaagtgaggctctaagattctggttcctgtcctgctgattatgaggaggttagggaaataatagcagaaatcacaataatagcaaattcctaccatatgctaagcattttcatatgcattagctagttttgtcctgcaaaaatgtctgccaagtattaatattattcccatttagcaaattgggggactgaggctcacagttttggtgacttgcccaagcacgtggaggtggtggtgaccgagctgagattcagacccaggtgtgcctgatggcccagtccctgccccttgcgatgccccacggtgtctgggagcaagggttttgacaaaccagccaggggcagtgggtgaggagagaagagaggttgagtgggtgggaggggtggccaacaaaaataagccaacttccagaaaggatggaaggaaagactcctggccacaaatagctgtccagctgcccccatccaagtgtacggtaccatcctccccagctgaaattcccactctgttttcagtctcttccaaatgcaagtcagatgatgtcactgctctcactgaaaaccttcagtggctccccattgctctcaggataaagaagaaaaacccaaaacctgtgctttaaagataaatcagccctctgggggctagggcagaggaaggggggaaaaggccccaaagtatagcagttgctgttttttgtgatgtgaagatactcactgtgacaagttacaaacagttaaccgccggttcataaaattcctgaaaatgtcacaacctgctccagcatgccagttcaagtcataatccccctgacagcacaccacgtgctctgtgccctgctcatatgcccagccccgctgggcaccgcattccccctggcctgccccgctctgtcctggccaacctactgcgggctctggcacaaaaataatccaggcatggtggcacacacctgtggtcccagctacttgagaggctgggaatctcaggacttgttaaaactcaaggtgttaaaactcaaagctccttctacctgccacgctgtctcccacccactcttgtgacctcagatcacggcagcaatgtggctgcttcagcagcgtctgcccagaactcccaggctcgggcagagtcccctcaacacactgatgcctccggggatctgatgcacttcacactttgatctgtgctatctcttgattcctgtgtgtcttctacactaaactgtaagctccaggaggggagggctcttgtctatattcccagcaaggacgtgttcctcactgtagtggataccaatggcaccccctggagtttggcaacacctgccctcccccacccccggcacccagcatggacgtggcccatcttaggtcatcagtgaactcttcctgaatctcccagttgagcccttgtcttcctgtgcttccttttggggcagctcctcccacctccattgaagtggtggctgctgacacaccagcccccttcagccgctaccaagcccagaacttcacgctggtctgcatcgtgtctggaggaaaaccagcacccatggtgagtacccctggagtgcccagctccttcctatctgccggaccaccctgcttcggggctggtccagctgcaggtgtcgccactgtgcctggaaagggagtggttggccagggctgactctgtccccatctgccttggtctgatcccgtttacccattggactggtccaggcatccatgtgcccctgttgctacccatctccccatgctgagaacccccacttctcctggagacaaagtactagaacttcacagcaggagcagcctttcggggagcccaagacccagcatgcctgaccccagttattgagtcccacggagacaaatgaaagggggccccgagaggaaaaggggcttgtcccaagtcaccatggcactcctgacagagctgggtctcaagtccgtgtctcaagctccaggttcactggcattcccaggagcccacatgatcagcaggaagcccatctgaaaggagggacaggatggaagggcgagaaggaagggagaaagggagggaagagagaggaaattcctttttgaccaacttattagacccaacatagtttctttgatatttgtcagtgcagttcacgagattttttatgacctcttgaagggggtggggcaggaggtgcagcgtccagagagctggggtcctggccctgctgtactcactgaacaaccatgagcaggaaatgccccctccccacttctgcctctgtttctgcaaggaagtttagggggctggacaatatttgtttttcagcttttttagtagcacgaggacccttttggtctaaatgatatacagggaagcctcatatatatgacatttaaaagtgaagagaggccaagtcactctcattgcacctgaagcacctctgtagaacccgtaggcttccatgaaacccatttggagaaagtttgggctacgtaccctttcaattttgacattttataatactttgggtcttgatcctgtgagtttcgcacagtactaggatttagcaaggtgtggagctagagcaatgggtacataggattacagttcaagacgggagccaaatggttcccctcattccagacccaattgtctcccaggcatggtccaattgtgcggccttgggaatctaggccagccctgccttgcgacctggggcagggtggtaaatgggtctgtagaggtccaggacagggcagtaagcaggtgcacagagacacaggtggggcagctggcagggtcacagggatgcagagatacaggtgaggcagtgggcagggatgcagagacacaggtgggacagcgggcaagggcacagagacataggtgaggcagtgggcaggggagtagagacacaggtggggcagtgggcaggggcacagaggcacaggtggggcagtggacagaggtgcagaggcacagatggagcaatgggcaggggcacagaagcacaggtggggcagtgggcagaggtgccgagacacaggtggggtgatgggcaggggagtagagacacaggtgaggcggtgggtagaggtgcagaggcacaggtgggattgtgggcagaggagtagagacacaggtggggcactgggcaggggcacagagacacaggtggggtggtgggcaggggaacagagacaagcctcagtccctaggaagtggacccaaaaaggtagcttcaaagccagttgctgaaagcaggacatgaccccagattttcccctttggaggccatagacaggtccagtctccctaaaatcaggaaagctgtttttttctcacagagaaaaagtcctttcctgaaaggcacaaagaaaggcttttcacagcccaggggctgtaggaagacccctcctacccagcctgtctgcctgccccaacatttgcgacacggcaataaaatattcagatatagacatgcaaaagaacctcatctccccaaatcccaggcatcttatgtttgcctgagacatcagaactttaaagtaattctttgatataaattacaaacctgcatttaaagcacttttcaaaaagaaaaaaggaaagaagaaaataaatgggggaaaaaaaaccaacgcaggctatcatgtgcagaagagattctttgttggcattacaaactccgacaaaaatcctacatttcctacccccatcccctcccacctccttcacccccctgcagtccctccctccacacactttccttccgctcccccacctgtgtcccagagagctgcatcccactcttccctctcccgcccccctatcgatttatttatcagatttattaaaaatacatccaatcccctcaggaatctgggcacatgtaccaaaataaaaagacagcaaattaaattaaatgccgcctcacaaaacttgagttccccgttagcagagaaagtgaggagatgtttgctctcacctcatccccgcacctagcttcctcccacacatgcacctgttttctgccttccatctccaaaacgcacacgcacagagattctttcttccctcatcctctcccaacgtctcacttcatccccggtgccttccatttttccctcatccccaggacctccctgagtgggcatggaccacacccttgggccccaggtggttgccatggtgtaggccgaagtccccatttcccatgtggttccactgatgcacccaacagccccatgaagcaggtgtcttattcttctcttgacaagtgaagaaactgaggctcaaaaaacctcatcagttggtaaatgatgggattgggctaagcctctgccccaagggcctgcatgtgttcccattgtaccacactggctcatagttcttgggggtgttgaagggaaaagagtggggtgagggctactgtctagactactatgctctggaagaactggcatcctgtgcccagttcatcggagaacccactgggaggttgaagttagtagcacaaaatcattttcccacaccctccttacaatggcaggtttatttcaaacgagatggggaaccaatcgacgcagtgcccctatcagagccaccagctgcgagctccggccccctacaggacagcaggcccttccgcagccttctgcaccgtgacctggatgacaccaagatgcagaagtcactgtccctcctggacgccgagaaccggggtgggcgaccctacacggagcgcccctcccgtggcctgaccccagatcccaacatcctcctccagccaaccacagagaacataccagagacggtcgtgagccgtgagtttccccgctgggtccacagcgccgagcccacctacttcctgcgccacagccgcaccccgagcagtgacggcactgtggaagtacgtgccctgctcacctggaccctcaacccacagatcgacaacgaggccctcttcagctgcgaggtcaagcacccagctctgtcgatgcccatgcaggcagaggtcacgctgggtaagacttggtgggggcccttctgtagagcccttgcagacctgggtgtggggagagccttggaatagggttcctgggctgaggacagccatggaaagggggaggagatggagcaaactggagtcaggatgagcacaaatggtagagtcaggttcttagggaggtttgctgagctggattggagaagatgggaggtacccacaggccaaggtagtttgctgggttgagccaagaacatgagaggtcagaagagtttgctggatagggtcagggacacaggagatcaggggaggtcagaggagttcctggattagatcaggaacatgggaggtctaggaggtcttctggaagggtcagaaacaagagattgaggagatttgctgggttgggtcaggaacataagaggttggggaaaagcaagggagtcactgggctgggtcagcaacatgagaggtcagggagtttgtacagtccagataaaaaagatggaaagtcagagaaatatgctggattggtgttaaaaacaggggaggttttctaggtcaaaactggaaccaggatgtttgctgggtaaataaagtatacacaagagtcgggtttcttcaggaagggttgctgagtcaagtcagaagcataggtcagcgtgaagaccaggggaggtcaagatttttctagtcagcctcaggagcacaagagatcaggggacatttgtcggatcaaggagaggaaccttgaggtcatggcatgctcaggggagttttctacatcacaggtgggaacatgggaggtgacagggagattttctggattgcatatgagcccagtgagctcagaggacagttgctgcataagggttgcaaacctgggaggttgcaggctttgctggatcgggttcgagaattctgaaagtcataggaatttttgccaggttggggtcaggaacacataggacatggaaggatatcactccggcttacacttttaagtacaatgaaaaccctgtcatctgtgggtatgtgggaggcaggcaaagaggacactggctgcccagagacagctcagcccaagaatctaatccatgtccatgatctgcacctctccccacagagcaccaacccagggatccccaaagcagttccctggtaactcactctcttccccttatactggtcctccccactgactcagggcagggaaaggggagatgtggaatcttcgttgctgaaaatatacaagactcatctccagttgtttgtatggactgggtgggcgagggcaggggatgggcacgatgacctgtgcttgtcctttcccctatgtcctttgaaccttgatttgcagcccccagcagctcctccctgagcccgagatgcctgggctcatactccaaaactcctgtagtgtcaggggctgcctggagcagtccacagcctctaacccaggccactcatgaccaaggactgagagcagtaactgacaagaattgggactgcagcttgtgtcaggtgttctagagagcttctgtttcatctggaccatcagaaaacccaacacctcctcagtatcaaataccaaagaaaaggatttcttgtacggatagtatgtactatgtgccaggaacatctgcaaggattctcatccaatcctcacaagcacaagttggctgtgtagtctcattttgcatatgagcaaaactgaggctcaagttggtagagtactttgccaagtcgttaactttgtatgtagcggcgttgaaatttcaagccaagtttattggtgccttcttcactcactaccatgccaaccactgaactcaccagccccaggatgtggtgtcttgactggttatgggactggttccctgaagacccattacaatggacctttgatattctctctctctctcttttttttttttttttttttttgacagagtctggctctgtcacacccaggctggagtgcagtgggtgatcttggctcactgcaacctcagcctcccaggttcaagtgattctcctgcctcagtctctcaagtagctgggattacaggtgccttccaccacatcctgctaatttttttttttaatagaggtggggtttcaccatatcggccaggctggtctcaaactcccaacctcaggtgatccacctgcctcggcctccaaagtgctggggttacagacgtgagccaccgcacccagcagccttttgattttcacaggccacctgcccatacagaaactaaaaataaaggctaacatttagtgagcacctactatatgccacagactgtggcctctcttatattaacccagtgagacaggcaccattattatcccatgtcacagaggaggaagctgaggctcagggaagttaagttgcccaaggtgagtgggggagaattcaaaggctccagagtctgctctaagcctctcactctgcctcctcacggcgtccctctgtcacaggtgcccacttcctgggtactctttgttcatcattccataaagatatcacaagcagggccaggcacagtgtctcacgcctgtaatcctaacactttgggaggccaaggcgggtggatcatgaggtcaggagttcaagactagcctgactaatgtggtgaaaccccatctctactaaaaaaaaaaaatacaaaacttagctgggcttggtggtgtgtgcctataatcccagctactcaggaggctgagacaggagaatcacttgaacccaggaggcagaggctgcagtgagccgagattgcaccactgcactccagcctaggtgatagagtgagacttcatctcaaaaagaaaaaaaaaaagttggggggaaaaaagatattacaagcatcacaaggccaggccctgtactaagtgctgggatcttcccaacccagagcctgctccgacccctctcttggtcctcctgcttttccagcccttcactcctctctctggaccctccatccttccatggcctcttcctcccctgacagagcagcctccaccctttacctggttgcttcatttatgaaagccccctcctgcccctcttgtggaagctctggcttccagcggggtggcacccttgccccaccccaccaagaataaggaggagaaagatgaaaggccagatacagacttcaaggcagctggtgaaaagtgagcttgtagctgacatcttctagtgatgagagggggtgtgcctctgctggcctgtgtgacccctatcaacagcaccccaaaccacattaaagcacttgcctgctctgtcctggatcccaggccctcccttaactggagccgcctctgtgggcacccccactcatcatcagagcaagagaaagaagggcccactcataagcagtgggcctggacaggcaggtctgcacacaccgggggatttggggcatgggggacacagcagggccaccaagatgaagggccctaattgggtgggtgagtaaagagacacctgggctgacttcctagcctccctcgactgctgagtgagaattcagacttcttaacgtctctgagtctcagttttctgacctgatgaagggggagaatagtaactgcacaaatgttttgagcacctactcagagccaggctctctgcaagatgctttcctcaccaggtctcctttaaacctgcagtgaacctgtgaggccgctgagagttgctatcatattattcccatctgagaggtgagggactcaggtttagagtaacctttcttaggtcagccagccaaggctgtctggccccagatctcacattcttaaccactgtgctctacagcccacctgtcagggctgtggtgagacgtcactgagccaggggatatgaccagtggaatgtgccatgagccaaagagtcgtgagtgtatgcaccttgcaccatcagggcaccctgcactctgggtgagacagtgggacggattagatgacctcagagcacaaaatccaatcattcaacaaggattttgaagatcaggccaacgagggtgggatgtgtctccctgcaatgagccttcgctcctcctcttcccttgcagggatgccctccgcagctgaaatgccacccctccaggaagatttctctgactctcccccaaccctttgagctgtttgtgcctcttctcagttcttgtctcaccagatttgtacctttctcgtaatctggaccacagatgcctgagcgtcctggcacccatctcactaaatggcaaccatgtccttcccattgatcaaaccagaagccttgcagacccctcaccttttccactcttccctcctatcccacatgcaaaccatcattaagccctggcagctcaacttcagaatatatcccaaatctgccactcctcacggtctcctctccaaatacccaacccaagcaccatcagttcaagcctgggttattagagtagccttcaaactgatcgttctgcttccactttcaccctatcctatttcccaccccgattgatctacttaaaatataaatcagatcatgacacccgcccaaaaccttcctgtggtagacaaatagattgacaaaacaggatagagtccagaaatagatctacatacacagagttcattgatttttgccaaagacccccaaggcggttcaatcaggaaagagaagttctcttaaaaaatgaccctgaaacaaatgaataggcataaggaaaaattaaacctggacccctgcctcgcacacacacaaaaattaatttgaaatgaatcatagatttaaaagtagaagtcagcatcatgaagcctctagaacaaaacatagcctttgtgatatttgtgtaacaaaggtttcttaaagtggtcacaaaataaaaactaaataaaaactaaatgataaattgaatttggtaaattggacttaatcaaaaattaaatcttctgctcttacaaagatatccttgagaaaaaagaaaagcaaactatagaatgagagaaaatactctcaatacatatatctgacaaagcatttgtaaccagaatatataaagaactatgacaaatcaataatgaaagactacccaattttttaaaaaagaaaatatacaaatggctaataaacatgtaaaaacctacactacattattagttattagagaaatgaagattccaacctccatgagataccatttcacatctattagagtggctaaaattttaaaaactgacaataccagatgttgacaagaaggtagaacaatcagaattctcatgctttgctgactgcagaataaaatggtactactactttgaaaaactggcagtttcttacaaagataaaaatatttctgttcttatgacccaacgatttcactcctaggtatttacccaagagaaatgaaaacatatgtccacagcagctttattcatggcaacagcaaaaacaacagaactgtaaataatctaaatgtccataattagaaaaatgaataaacgtatttgtagtatattcatataacaaaatactttttatcaatacaaatgaatgaactcatgatacctgcattagcatggatggagctcaaaaacatgttgatcaggctgggcacggtggcttacacttgcaatctcagaactttgggaggccgaggcaggtggatcacttgcagccgggagtttgagaccagcctggccaacatggtgaaacctcggctctactgaaaatacaaaaattagctgggtatggtagctcatgcctgtaggcccaactacttgggaggctgaggcaggagaatcccttgaacctgggaggtggaggttgcagtgagctgagattgcgccactgcactccagcctaggcaatagagtaagactccatttcaaaaaaaaaaaaaaatgttgatcaaaagaagccagatgacagagtactcactgtgtgagtccatttatttgaaattctagaacaaaaaataaatatccattgatagaaatgggaacagtgttggcctatgaagaatggaaattgactggaaggaggcctctgctcgagtcctctactcagagggtccttccttgaacactctatctaaagcagcctcttcctcctggttccttccaccccttctcttgctttgttttcttacataactcatttccacctacaagtatattctatatttgcttattgtctgaatcgcccacaaggtaggaattgagatttggttttagatgtaatggcagtcaggtgaactggcttgaacaattcattcttcatatatgttttaactgtgataaaatttacatattgggaaatgcaggtccttcagtgcacaatttgacagattttaataaatgtgaatgctggtgtaaccaccacctcaaccaaactctgcgcattcccatcacccactagaatttaaatggcacatgggcagggtcttctttatccgcctagttcacagagtacagggctcagaacaaccccaacatagttcttaataaacaactgtttaatagttaattaattaatgcttttctaggttgttgagaagattaagtaaggcagtgcatacaaagtgcttatagtgacaggcagaggaaatattcaggaaatataagctactgttattattcatcatagtatccccaacagtgaccgggaatagtgaccaccacaaattaggtgtacaataaagaattagatggatagagcaaatgaagaaatggatgggtaagcaaattggtaggtttatgggtaggcacttggatggattgttggatgtttgaatagatgaatgaataaaatgaatgcttggatggatggaaggatggatggatggatggatggatggatggatggatggatgttttgatggatggatggatatttggatggatgtttggagggatggatgaatgggtggatgtttggatggatggatagatggatggatggatggatggatgtttggatgggtggatggagggatggatggatgagtgtttagatgggtggatggagggatggatggatgagtgtttagatggatgaatggatggatggatgaatggatgtttggatagatgtttggagggatggatgaatagatggatgtttggaaggatggatatttggatggatggatggatggatggatggatggatggatggatgggtggatggatggatggatggatggatgagtgggtgaatgggtgagtgattgtcttagaaagcatccagaattcctaggggaaacttagaggagcttttccttgagattccacagtactatccttgcatcaggatgctcaggacaggtaaggaaggcaacttatatgtccaggatctttttcattccctgagcagatagacatcactttacatttcacattgcagtcttatctccctcctccattgtcattttcagagtatttcctcaagcagggtggtagcctattctccccatttacaagttagaaaactgaagcccaacaagttgaaatgactcatccaagtcatgcagccagaaagtagagggctaggtgtcaatcctgggtctctggactcctgctctttctctacgtccagggcttgagaggcaggaaagtccggagactaagagcattcctttcgggcactctcagccattgtggtctagaagcaggcaagggggtgtaggttttgattgtctggagctgctaatgggccaggctcggagtgtcaggaggctgagggtggaaggagtgaggaggctgacagcagcaggcttggcttccagaagcaacatctcaacacagcagtaaaagagggagtcagggaccatcggctgcaaacgcacttgtctagtggcagctgccaggatagagcttgaaagcagcgagggaggaccagacccctcttctgcccaccctctgtgcccctcaggatcagatgcacacaggagcccaggagccggggtgccctgggtggaagaaggcacccatctctgccccacctccacccttgggctctgagactccctctgaagccctatgtgctatcacgtcttgttactggtacttcctatagcatgaccttggacaagccactgcccccctggagggccagttctatgacctgcacaatgggtttcgtgataacctgcctcgtaagtaccagaatggtgtgactgtcctaaaatgcctaaaatggagtctagcgcatgtttgacacctgagaaaagttggttccttcttcccttagaaccagcaggcccaggcccgggcctgaaggagtaaggcaagccctttagaaagcagggcagtgaggaatctaacctagaagggaaaggtgtctgcccctgccctccagggctctagccttctccaggaccgggatgcccttcagcgccctctcctggctgcagccaacaatgccgccccagcagcacctgaagaacgtaaagagcccccaagattacccaggggcagactgccctaggcctggtttcccatctgcaaaacgatgtctacagcacttgagggttcattttaaaacccagaaacttacttgggctccctgagccttcatttccttatggcgacaatctcaaaggctggaaggctaaatgagattatgcatatggcacttcatgtaggtcctggctcttaggactcgctaaacaaatgttagccatcaaacctgccactgcctgatgttcctaacggccccgcgtgttaggcaaggggtatcattgttcccatggtgcacttgggaatgcgaaggggagccactcatccaagggcgcaaagaacagattagaactcagctcgcaggtatcccaggccagtggcccttccacacgactggctggcagatgcagctgtagaaccagcccttcccttcccagcgattccctctccttggtgcaagccctgctcttcccacggatgcttccctagacccatgtggcatttcagatgtcttgcttatggtttaattaatagtcctttgatttcattctcagagaatgaaattggcagtgcctgggaggccacccacatctgccaactgctctgatttccgttctaagagctttgcgtcagaaagagaggtccggggaccagcaaggaaaggtgggggtaatcccagggcagccccagggcctcaggacaaaccttttccacccttagaagatgtttacacagagtagcacaaagcatagagtaccaaacaaaaccctcaccccttcctccggccctggaaactcaatgggatctgtctcccaacccccttccctccctgacctgcctctgtcccatgccctggctgttccctgtgcctggaatatgcctcgtgagcttcacagctcagcttaaatgtcacctccttggaagaggcaccctgaccactatctgaggatttcacccaccaattctgagccccctcccttggtctagtgatctgcatggagcactgtcactctcatcctgttttgcgtatgtgtttgtttgcttatgaactctcacccctactgaagtgggagctccatgtcagcaggcactgggtcttgttcaccaccatatcctcagctctgctccaaatggctggctccataattactgttgagtgagtgagtgagtgaatgaatgaatctgggggaaagagtgctggcgagaaggtcaggaaacatggttaactggctctgtgagtgaccttggataagcctctacattatccgtggagctctgtttgtcagctgaaatgaagggaacagacccaatgatcccgagtggctcctccatccctgatattctcaggtgtcgttcagaggatagccatgcctttgggcatcttggctttcaagctcagagatacaaagggactgaataagaggtgatacaagaaagtgaggaagagaggcagggaggctgtgcacaaggaaggaggtggtctttcttcccacaccatgtccacccctacccagaggttctagaaaaatcccactgggaagattaacctgttagaaagagcactgactcaggagtaggagacccgcaccttgatcttggctctcctcaaggtgtgacctttggcaaatcacttcatgaccctctgaggcccagttaactcaactggacaatggggctgatgacaccagaaacgcacctcccaagggggtagcgtgggtgggagttgggggtacctcaagtctggctgctggtgcaggctgctccccctcagcagcctagtagcacgtgccccaggtacgtttccctccctgaccccactgtccactgggcctctctgatcttgtccctcatggcactggcttgtacttgtctgttgtttgtctttcttccccactgatgtgtgaaccccccaagagcaggaatcatgtcctatatacacccttgactccccaggtcctagagagcatctgattcattgcatgggcttagggaatatgtctgaatgaatgcagctgtgaatgagtgaatgaatgaatgagcacactgagcttctcacagaagcagctgatcccaaggatgttgattgctagactagaactttctcttccatgtaccctgtccctcctttccttactctctctgacctggcctttctctccctacagttgcccccaaaggacccaaaattgtgatgacgcccagcagagcccgggtaggggacacagtgaggattctggtccatgggtttcaggtcagcctctctctgagcatctgggagggtggtgggaggtggtagaggcaccgacccagcaccagcattcctggcagtcctctctaacactcttcctttgatccccagccacatccagtgggtttcagtttcccaatgtgtaattgggagaatcagctcccatgaggaatggcaaagaggtgcatgcatgtttcacaccttctagaactcagagtaaacctagctcttcaacgagacattctcttaagtcccagactcctcctcctcctggagttcagggcagccactcctaacccgtcggatgagaatgctgtgccacccctggccaggcagcccctgaccccttgctgatctggcagaatgggccctcctgtgacccacctctcccctgatctggccaacagaacgaagtcttcccggagcccatgttcacgtggacgcgggttgggagccgcctcctggacggcagcgctgagttcgacgggaaggagctggtgctggagcgggttcccgccgagctcaatggctccatgtatcgctgcaccgcccagaacccactgggctccaccgacacgcacacccggctcatcgtgtttggtatggcgcgctcaactggggactgggagaacaaccacaggggcgggtcctgtctgggaggtttccccaggaggaagaagcagtaggggcccaaaattttgggcctaaatctcccaaatttgccctgagagggtgccccactgggaggcagggtcgctcagtggttacaactataaatcagcttcggactcagaaagaaccttaggcaaactgcttaacctctctcactttctccatctgcaaaatggggctgatactatccagctcccctgaaggttgtgtggctgcactgagacagtgcgtgtgatacctcacagcaggtgctgggtaaagggccattccttccctgagctctgaaggccatccaccctttggttctctttctgtttctttccaacagaaaacccaaatatcccaagaggaacggaggactctaatggtaagtctctaccctcaggattttttgcttaaaagggagtggcttttgaggcgccagaaagctctggtcccccaaacttcccatatgcacacccttgccactccctgacacctcaggcaggtcattgccctctagtagggcagagtcagggtccaaagtgggcagaggtgggtactgaggcaataaaaagggactcagcctgccaaagcagccagctgagatttccagggccaactctgccccatctcaccatccatggcatctctggccctcttagctcagagcttgatctcactgcccatggcatctctagctttcttagctcagagcttggctgccctgacctcagaagggtgtgtccagcctcgaccgtggggctgcgttctgagactccagaccactccgtagggtggttgggagcatcaacggatgtctcagtgcaggccctttatactgtcctccctgggcatcccccaacctgctctagcctgagcaccaccccagggggcccagacgctgctcccaggcctgccacaccccctccctacatggagccaatctcacagttcacaatggaggctcccactcttggtcctcactgcaccatcctcatggcctctaggaaatctgaccgtagcccagcaagcctagtggtaggggaggagatcatggacagttaggtggccaggtggcagagctgggcttcgaacccagtttgtcctgatgctgaaatccagcgtctttgttggggacctggaggctctgctgttctggaacggggttgggtctgcaggctctgaccctttccctgattcctggcacaggttccattggccccactggtgcccggctcaccttggtgctcgccctgacagtgattctggagctgacgtgaaggcacccgccccggccactccatcaggcactgacatctccacgaccggttttcatttcttttctaaactatttccagtcttgttcttagtctctttccatctgtgtcttggcttcttcagtcggtttaattaaaacaaacagaacaattttcccca

SEQ ID NO: 822 - DNA, 154068 bp, Homo sapiens
ccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgggctggccgggtgggggcgagcgccccgctttgttgtgcggcatgggaggaggcgggggcttaggcccgacctggaggcagtggacggtcgccggaggccacatggccctgctgaaatggccgagtcgctcaggtgaccatttgtcatccatccatcgatgtcactcaaggtgcagctcagagatgaacttggggatcactgtgatttttctttcaggactgagcctggaaacgggtccaggcacactgaaacgtcttcattaaagtttcctggacagagtttattgtaactaagatcatgtttggtgatgaactttacctgtgacaaattgaaggcgcactagaatgggtatttgtacaaatgcctttttttttttccttccgcaaggattctaccttaaggctaaagaatgtacatgacatccagaaagccgtacagggacagagagcagcagcttgggaaaaggggagccaataggttgcggccccagggggacaaaggaagcttaatttttgactgtgttccctttgtaccatttgaactgtgtgccaggtgggtgtatgaatgcaaagaaagtctctgccttgtaacccgccttacaggttcttttccgtgttggcttttccacatgtgattcttcccacaggaaacacctccaagccatttggactgtggtgtctggctgtatccgtcagatattctgggggatctactctgtaaccaatccttaggtgtttgtagttgtaaatacctgattttgctcttacggacatgtggcagtcactcagtatttgttgactactgagtgaataaagacttctgtttttctctgtatgatacagaaaagggctttccaggcaaacccttattcattcctggaagcccactgtgacctccaggagaccttccagactcagccctctcacatcgcaccaggcctaagtctccctggctccacggccctccatggcatgcccgcgcctggcatggcagtcaggataccttatcattatttgtccacctgtagaaggtgacacccagacaggaaatatcttacttttgtatcccaagagctcagcacagagccaggcacatactaggtgtttgtctatgtctgttacattaattaataaacaaaagaagtacaaggcatttaaaggacctttggctaaatatagacatttgctaaatatagtagcttgagtataactccctcctgtgaagacagtcacttatgtatgcatttgaccacagtgccttacaagtgttccctgcaagggccagaggtggccagtgaatcgcaagccttgtcttgatgtcagtggttatggggcagaagaatgagaagaatgaaaatttccagagtttgccttttatccactggtgtttctttcttcttttttttttttttttttttttttaacacagtctcactctgttgcccaggctggagtacagtggtatgatctcggctcactgcaacctccacctcccaggctcaagagatcctcctgcctcagcctcaccagtagctgggattacaggcacgcaccaccacacccggctaatttttgtatttttaatagagacggggtttcaccgtgttggccaggctggtctcaaactcctggcctcaagtgatcttcccgccttggcctctcaaagtgctgggattacaggcgtaagccactgcgcccagcctatctgctggtttttataaaatagattgaaaaggaaggcaagggaacactccttgggttgagagccctgaggtcctccctcccaccgagggagatgcagttggagttacagagatagacttgtgagtcagagctgggctttcaaatgacatagttcttagccagctgtgccatcctaggaaggtgagttactcactcttctctgggcctctgttttctcgtctctaaaatggagaagaagaaacctcccctggctgtcagaattaaagaaagtgggtagcaatgtaaagtatgtaactaggcggtgggtaaatatgagagcttcttacacgcccctcccggtaaaacccagccgtaggtgcagctgttactagtgctgagtagcacagattgatagggttggagggagcaggtgtgacatcttatgttttagtacaaattaacttctatttctcaactgtgaaaatgaaaatcactattcaaatggcaaatatctactccttgaattcatcagggttcttatagaaatcaacaaaatcgtcttgggttcagtactttcttattcactcattgactcaacagatacaagccatggtatccaaattcctgtcctggggagactggagagtcagggaggaacccggcgaggacctgcctgccctccaggagttgggtcagaaaggggttgacacctgtagatcaataatgctaaccgaagacaggaagggatctgatataaaaagggcgtagacagtgttctgaaggtttggacatgagagagaatcacagccggccagtggtctcagaagtggcttcctggaggaagtggcattttgagttcttgaaggctgtatgtaccagtcaagatgctttggctgctgggacagaaaccctgactggactgacattgacaaggggaagtatattggctggagcacagcaagcccggaggcagggcaggattccccgccagcctcaccagtggctccggcctctttttcccacagcacctgcgcagctggttgggctgggccatcctctgtgggtggcctcatcctcaggctgacttgcttcatggaggccagctggccttggctttcccgggctgccactgtggagcccacacaccgtctcttctggtggctctctccagagagctagcagtatctccctggtaaactttcatgagtctgtctggccactcctgcaccaagctctttgacaaggaccatggacttaggggctcagtgcctgtggcaaaggggggtgggtctaccctgtgacctgtcagactcatcctgggactggggagagccggcctccctgaaacacttgggaaggtgggggcctgaatggaaactggggaggcttcaaggaagtgggagggagtgggctgccacttgggcctggcacccaagaacatgccttctggagagtaagtggaaaattctgggctgaggtcattgggaagcctgagtcacctggcagggacgtgggttccagttcgctggagcgaggggaagagctaggctgccctgtgcaggcagggctttgcactcttctgggtagaagcaggactcgtggtgggggcagcctttggagggtgcatttctgcttctgcagccggtgtcctgcttccatgtgatggtttaaactctaggcaagcgtgtatagtaaagggagttatttgcaaatgctgtattatcgcaagtcaattatttctcactctcttgttgcagtggaattcaggcgggatgttatcaggagaaaggtttagtacgcacttgcagaagctcattagcaccaaaggcatgagctgcgcctcccacttctggggaggggtgtttccaacgcagatagattttcctctcctaccgcatttcacattctactggtgcattttggtagcatcccaaacttctcattcagcactctgcagctgagtaaagcgatactggtctcaccatgcaattcaaagtattgctctcaaatgaagaatgtttttcccaacaggaacagtcatttgcgcaggctgcattaggaactcaccgtggggccttgagacagtgcggtgagcttattatcccctggtggtgccataggtaccccttcctcacccagcaggacggaggccctccccccataactgtttctgcagcctcctctccaagctggcccctctgtggcctgcggcctcgggccctgatccatggcaggggcactgctgccccacccggctgcttcaccggccccaagttgactcgtgggcctgcgggtgctgttggttcaggcctcacagccaccgcctttcacttgagccacggccacacaggagtccagttgcggagaaggggtcgcactgcccccaaggagtccagttgtggagaaggggtcacactgcccccaaggagtccagttgtggagaaggggtcacacagcccccaaggactccagttgtggagaaggggttgcattgcccccaaggcagcctgcagccatcaagtaaccattttgtgaggtcacaaaatgtcccccaggcttgtttcaagatgcaaccaattctgtggtacgtttcctgctccggagctctctgcgggccaggctgaggccaactcctgccgagaccacctccctccccagcccttccctgactggcctgcccccctcatgcccctgctgggacagggctcacatccagtcctgccatgggctctgcttctggaacccaacataaagccatgccccttgtttcaggtagttcgtaaatatcgggtcttttcatcctaagtccccctttcattcatcttttctccctgtccttcccaaatagccctcctatatcaacctgtgcggagggagcctgtctctcttctcctcaaggctgttggagaaccaagctggggatggggtgcacgtgttcttttccagaacagcccagaagtggggttcagtgtggaaacttcgctctacctctctccagcactaacctgacctggctcctctggggtggagagtccaggactgagcccagctgcaaagatgcaaatctgggtccccaatgcagtcccttgccctctggtgaggtgaccctggggccagaattcacctgcacgcaaccaagatgtcagacttgtccctaggcctatttcacttgatttgaaagtgaatttcatgacttttttctctatgaatttgcttttctgaggctggccagcagattgcacaccaactgagtgctgctggacactggtttgccattggggctgggccctgcccctttgttccacaggagttgggagaggtgaggggcgttcagtgcccggcaggacacaggactgtccagcctgaacaacatcctgcctccagttggaacccagccgcagtggagtcactgagggctgttctgcagctgattctcctaagccaaacacccatcttggcagatcgtctacaaggttttaggaatgtgacaagactggtgttccagacggatttttaccaacagtctgagctgttggagggcgtgaacaatgtgcctgtgaccttgggctgtttgtgcgattcccaaaagatgcttctgggtttctgagtccacagaaaactcagctgtggacaggcctgctggtccccaacggccctgggccccaccccacagctatttctgtcagagggccagctgtctcccttcttccttttctgggtgactcttgagccactcgttggcctggtactcagggttgggatgtgtgtgtggagaacatgacctggcttctagccctgcctgtcccccgtgagccctgcccgtccccagtgagtgtgagacgggaaaggagagaggggcgaatggaggttgcttctaagacccaaggtgtgccaggtactctggaagctttactcccatagtttgtttaaatcctgtgaaaagagttccgagtctctctgtttgacagagagaaaacagactcagagacaccatgggacatggctgaggccacctattaattaggggctgccagttcatggcccaggctgcttcctggatcagcccctcagctccctccaagaccccattcaggctatgtcctgcaggcaagccaccttcttcctatccctggcacatgtcgtcccccactgacctgtgaaccaccaggggtgacatttcaggagagagagtcccatatctgtctctgccttactgtatctctcatcttctttttccatcctttcatctttaaaaaattgatttttatttcatcagagtaatatatgtttttacccatattctcaggccgttccccacacagtaggctgggcagtccttttaaaatatgtcagatcatgccacttctctgataaaaactttccaagggtgtcttgtatcactccgtaaaacccaagtccttaaacaagctacaagaccctcaatgatctggtaatgatctccttgtttataaataacatacatatgtattacacattagtttatcaattgcagatgctgtcagctggctcctgcattgaaggacgggacttggtgtgcatgggcccagttcaggccagctccctactttccttctctgcatcacactatagttcattgtagtgtggggctaaatgaatattcactggcaggacagactgcttaagaatatgggtgctagaatcagatttcctgggttcaaatcctgattctgtcccttataccatgacttagggcaagttacttatcaactttgtgcctcagttcccccataggtaagatgggaaagttttaggagtatacttcacccagggcagttatgagggtaaatgagatctttcacaaaaagacctctgaacaatgactgtcacatagtaaatgctcagtaaatgctggtgatgatgatgatcttgccagctgtgtaaataatgtcaattgcagagccaagcagtgtactataatctttctttccttatacaactttctgcttcttctagagttaatgatttattttctttttcattgctcatctgcctacatatctagcttatctatctatatatctacatatctccataaagttttcaatagaacccatcaaaatgctatgttctatatgattaaacaaagcagataatctatcaattccattttattctcccatggaaatctacccactagagacctctgtcctctagatccagtctggtctggatgttctcctcagggtttcctgcacctgccattccctctgccaccattctgagaatttcttttaccccctttttattgttgttgttaggtccctattttctggattccatattatctgccttcttggattgctgtcttattttgctggaacacatccttcagtagctttcggagcaagaatgccttttctaagtattcacatgtctgaaaatgtctttattctacattcatacttgattgatactttggttgtgtatagagttctaggttaaaaataattttccaaaaaatgatgaactctgtgtcttctttgacataatttccagtaagtattgttaattggaaaaagtaatatacagaaaataaagatagcatgctgttccttgtgtgagaaaggctgcaattttcctgcatttgaataaaaatcactggcagaacacaatgaaaggagtgtggggatggaggtggaagcaggttgtcaagtgccactcttcatgctcttgatatttgaaccatgtgactgtattaactagtcaataaaataaactaataaatatcaaaaaagtaaaattaggagccaggcattatggctcacacctgtaattccagcaactcaggaggctaaggtgaaagaatagcttaggaccaagagttcaagtccagcttgggcaacaaagtaggacccttcctttaaaaatatattttttttatttagctgggcatggtgatgcatgcctgtagtcctagctatttgggaatctgaggcaggagcatcgcttaagcccaggagttcaagaccagcctgggcaacatagtgagacccccatctccacaaaaaagaaaagaaaaagtgagtgggtgtggtggctcatacctgtaattccaacaatttgggagggcagtgagtggatcacttgagctcaggagtttgagaccagtctgggcaacatggtgaaatcccttctgtactaaaaatacaaaaattagccaagcatgatggcttgtgcctatggtcccagctagttgggaggctgaggtgggaggatcacttgagcccaggggacagaggttgcagtgagctgagatcacacccctgcactccagcctgggttgacagagcaaaactctgtctcaaaaaaaaaaaaaaaaaatttaaaagaaaaagtttggaaacttttaggatcttctctttattctcagaattctggatttttcccccacttattgagcattcattgggttcattcaatctggaaacttgtatcctaaaattctgggaaattttcttgaattttttcctagccccatcattttttctgttctgtcttacagtaatttctgtaagacagaacagaaaaagaagtaatttttcattttcctttcttttcttttttttttttttttgtcttttggtaatacttcaaggaagattcttcaactttaccatccactccctctactaagtttacctgttttatattgaattgctaagtttttttattgttctttatctctatagcatcctttcttgactcactaatgcagtaccttttcttactactctaaggatattaagcaaattcacttaatttgggggttttcctgaaaatttttttgttccctgcatcctggtctgtttcttttcctcctttgtgtgttttggcctctgtcatcttggagcctttctcagatgtgtggtgatcctcagctaccctttcatattttagagggaggcactaaacatggtgactacaatttgagcaaaggccaggaagagagatgtcacaaagtgtgaacaggaagccacacagggcggctgaagtgttggtaccagacagtggttcctcaggcaggggcaagcagctctgatttgaacccagtctcttgcctttgaggccagtgcccttgaccaccatgtcagtgttaggaggaaacattgcttaatgttaaccagtcagacttctctaatttggtgcctgcaggtggagttttgtttttgattaagggactagtaaggctggaaaagaaagttgaaaattaatctgagacatacaccagggaagaacggctaacctctagtgtctacacagctcaaacaaaggaacccatcattatggtattcttttactgagagcgaaataaaatgtcaaattagctgagcaaataaagatagtaaaacaaaaaaatatgagattttcatagcttcaggcatcaagaattgggctgggcatggtgtcttgtgcctgtaatcccagcactttgggagaccaaggcgggtggatcacctgaggtcagatgtttgagaccagcctaaccaatatggtgaaaccccatctctactaaaaatacagaaattagccagatgtggtggcttgcacctgtagtctcagctactcggggggctgaggcaggagaattgcttgaacccaggaggcagaggttgcagtgagccaagatcacaccactgcacgccatcctgggcagcagagcgagactccatctcaaaaagagaaaaagaagaagacaaaaagcaaaggaataattcatttatttgcttggaaagttctctaagatctgagatatactttccataaaacaaataaaatacctggagagtttaggtaggcagaatgtgatatggccttggcagcaggtaaactcttggatcagcaagtctctgagagccagatctgttcagagcctccactggcatattatattacaaactctccatccactcttggcttggggagtgaatgaaaaatcacatagtggtcatgatcatatttaaacataaagaaatcaggagatctaaagttgttcatgtatttttaacctccatcatgtaggtttatcaattttgccctcattgtccttgatttctttcatttttatttttcactttctttgatgacattccttaggcatctgggaagatgtggggttttccaggttgacactcatcgtggtttccatgctgaccaaacagctagcatggctctaccctgtcttccctaagacagcagcccccaatctttttggcaccagggaccagttttgtggaagacaacttttccacagaccagggtgtggggatggttttgagatgattccagcacattacatttattgtgcactttgtttctattattgttacactgtaatatataatgaaataattatacaattcaccataatgtagaatcagtgggagccaagagcttattttcctgcaactacacggtcccatctgggggtgatgggagacagtgacagatcatcaggaattagattctcataaggagcgcacaacctagatccctcatatgcgcagttcacaataggtttcgcactcttaagagaatctaatgctgctgctcatctgacaagaggtggagctcaagtgggaatgcgagtgatagggagtggctgtaaatacagatgaagcttcgctcactcacccgcctgccgctcacctcctgctgtgtgtcccagttcctaacaggccatggactggtaccagtctgtgccccaggggtaggggacctctgccctaagatattgctttaaattacccccagcatatttttaaatcacccaaagctgtgctgtctataggactctgtgctctgtgtctgtgcagtgcactgtggtagccactagccctctgtaattactgagcacttgaaatgcggttagtacagttgaggatctgcatgtcaaattaactttaccacagtgcatttaaaggtaaatagccatggaagtcttggggctgccgtgtcgaccagtgtagctccagagcaattcccttgtggaaatacattgcaatagaggtatgttctgcaatgtgggatatttattgactgcttacacatggggctgcataccactcatgaccaatgcaggtagactggactgatcgatggactgatctattgcaggttggaacctttgtggggctgtggcctcagagacctgtgggtcagcctttttaagttgtgtgaccgtaggcaagtgaatgcagcccagtcttcttttttttatccgagaaagaggaatgctatcgtgtggggcagtcatggtaaagagctagagcccacaggctgcagggcgtgctgcctggcacctggtaggtggcaattaaatggtggtggtcgtttgctaccttcaggtggctgtggttagctctagaaggaggcagttgtgcttcttgactggttgggatgtgccccagggctgagatgggggttgggtggagcttgtgagaaaaatataggaaagatgatctcccatgcccaagagggacacagacggcccttgggactgatgaaatgaactcagaataaaagcgcgaatggctgtcgctgtaaatatgtgtgtctttagtgtcagcgtccctggggacttcttataagtttgaagcatgttaccattcttggcattgagacagccagtgtcacttttacttcttggtcttgaattcaagcatcaacagtaaggtaccatcagatttttcaagctgcttcaccatcaagcaacctagccttggtgcccaggtctttggttggcttcccagaaataatgggccacttcaccccagccttgttctgcacggtttatctttgggcttatctgacctcttagaagctactaaattacccgcctatttttaaccaatgcctggagccggctccagaggaattgccacatgagttgagatgaggtgatgaccacatggtcttccaactcttcatttcaacatctgaagttttttctttcttttgtcttgtgttagggtttctcaatctgggcactactggcatttagggctgggtaattctctgtcctggggggcgctgtcctatgcattataggattttgaacggcatccctggcttctgcccagtaggcgccaggagctcctcgctattcccagctgtgaccaccaaacatgcttccagacattgtcaaatggcccatggggaacaagatacccaactgaggatctctgtgtcaggtttcccctgccacactgctgggtttgtaccttgagctctgaaccactcccctcagctagagaactctgagtctgacagtgactacgactgtttgccctcctgcaaggagggtaaaaagccctagctgaccacattacattcttggcgtttcctgcatttaaacctcctggaaattagtacagagggggccacataccctggaagctgagatggggccattttagaagtcggctgcaggctcagggaatggagacacgagctgccaatgtgattacactttgctggctttggaagtgtgcttgagctgacagtggggctggggaccgtctataacaagataccacagactgggggctttagcatggaagttgatctctccctgttctggaggcaggaagtccaagatctaggtgccggcacattcagcgcacacctcttgtctgcatcttcagattactcaaaatccaggtgtggctgcaggagaagggacagggaagaccctcaactttagtctcacctgtggaggtggggctggagacccagtcgtccttcaccccccaggaccaccccccagatgagaagggggactggatgttggacaacagaaaggtcagtgactgccacatttccacaggattaaaaccgtccccatatctcccgtaaaagcacattgccgaacttcttaaaatagatgaccagatcattgtcttgttcggaatccctgctgcctcagccctgggcctccgcagctctctgcacgatactctcctcatcacctctcaactgatctccagaaagtactgtgtggcccccgcccctccactcctgttcccagcgagagaagcccgagaacctgcagtctctatccaaagactcccccttccaacccctggcctctcttttcgcttggccaaaaggcgtgcatctcagcctgctgggatgggacaggaagggaccattaaccatgtgaatgttccagcatattcacctctgtggtttctacctcttgcttctgtttttatgtacaatttgcaaaggaaaacacccacatacactgtccctctcactaattgaaaattcagctttaatattctgtttggtttcatcaataatattcttttaaaaaatggtattcctcccagcactttgggaggctgaggcaggaggattgcttgaacctaggagtttgagaacagcctgggcaacataacaagaacccatctctattaaaaaaaaaaaaaaaaggccaggtgcagtggcttacaactgtaatcccagcactttgggaggccaaggcaaccgagtcacctgaggttaggagttcaagactagcctggccaacatggtgaaaccccatctctactaaaagtacaaaaattagccaggcatgttggcaggtgcctcaggaggctgaggcaggagaatcgcttgaacccaggaggtagaggttgcaatgagctgagattgtgccattgcactccagcctgggcaacagagtaagactctgtctcaaaaaaaaaaaaaaaaaaattgtgttccttttggtttaagacttagtcaatcttttctccttggatttctgtttttgtgattggtgttaaaatttcaatctatttttctttcctaaatatcttttccaatttttccctatatagaacatgatagttaataaattatactgaatatacgtgtggtgggaggactgccttgcagatccacaggttgcactctgtattaccaatagcttgtttttttaaatatgatttttaaaaatatgttaaagtataccaggtgaaaataacatataacatgcacaatatattgtacagttttgtgtcttgcttttaaattttttgagttatttcagataaggatactcctgacacttgggaggacttccagggcgtcgtcttagatggctgtgtgcttcctttcttgggcccttgcagagttcaggtttctgttggtgtgaagttttcctcctaactcccatgactggagacacttcgcacacccatgagagaatctttggggtacccagggagagtgtggtgtagagggtcagcattgggtgctgcggccaggcgacctcctcagacaagcgacaagcatctctgagtctcagtgtttccacctggcaaggggaggcgatactgggtggctgtgaggagtctatgaggcaatgcagacacgaggcttaggatgggccttcagggaatcatgctggccaaggaccgcgtgtgtgcagttgctgctgtctgccacctgtgctcaaagactttcagactcagaggccgaggcctggcttctgtccccagcttcactccaggttctaggctgcacgcctggttccaggctctaggcctcaggttcccagtcccaggttctaggctgagggttttggttctgggttccaggctccaggttccaggctaagggtttcagcttccgggttccaggctccaggctccaggttccaggctgagggtttcaggttccgggttccaggctaagggtttcaggttccgggttccaggctaagggtttcaggttccaggttccaggctccaggctccaggttctaggttaagggttcccagttccaggtttcaggctctgggataaggcctcccagttctaggttccagactccaggcttcaggttctaggttccatgtttcaggtactaggctaagggttttggttccaggttccaggctccaggcttccagttccaggttccaggctaggggtttcaggttccaggtcccaggctaagggtttcagttgccaggccccaggttttaggctaagggttcctatttcctggttctaggctccaggcttcaggttctgaactctaggttttcgattctaggctccaggttgcagggtctggactcatacaccagctccaggctacctggagagggaaggaagggctgcagggccaagtccgcccccgttttaccacctcctctataaggtgggataaatccgcctgctaacctcacagagttcacatgaggtcccgatgaggcaacatttgagatgatgcacataaagcctaaagggctttgcagctgtgagatggtggtgatattattgtcagaaaggtttaaaataaattcttaaacactcagatgtttcaggctagtttgtagctgcttctgaacatgcagcagtgtgctcatgggccacagggccgccgcgcactcgctacacctcttttggcaacgctgttgctttcctctccaattggaggagagctacaccacccagaatttgctagaaatgctgggtcttgagccccacctgtgctactgactcagaacctctgggggtggagccgggcatttgggcttctgacacacccccggacgattctggcgcaccctcgccttcagaagttctgccttcggtagacggatgccgttggtgtatctggctatacagatgggagaatccatttactctgatgttcctgattagcagagggtggctttttcctgctcagacggctgaggagtgaatgacttcggtcataaccgttaccattgctgtgaccttcccgctgggcgaagctgctagttgaggatctgctccctctcataggcctccctcccttctcccaggggagagcctggccagggcccccagcccggtgggtctgcacttggcacacagcagaccctggatcactagcgtttagtggcagaaaagtgagtgagtgaatgaatacaggaacagatgaatgaatgaatgaatgaatgaatgaatggacttagcttgacttcacataacatttggaaattctgattgttttcaaactagaacaagatttgaaaaggcttgtcagaaatcgcttacatataagtgaaggtttaaggaagcgggatttaatttggccaggtgtgggttctcagaaatgttctttttgattccccttcactctggccagggtggtttgcgaccttacccctccttcatgtaataagatatagaggggaaaattaaagcaagaaaccaaatccttttcctgtttactcctacagtttttccctctttccagttccttgtttttatggtttttcctgccttgtgtttctccgttggcttttgttgcaatgtatgcacttggaaaaaatcttctgaatgatcctagtgatggggctttggcctcattgggcgttgtgtgcacgatcgggttgcattgcacactgccggcgcgatgagctcgcactccctaaaaaggcaatcattgtgtccaggaaaactctgctaggttaatggcacatgcccaggggctgaagtcacttggaccaaggtttgtagaacatgctccgtgtggctttcctgttggggcagggggattgggccagaggaatttaggtgtattaacacagcctgccaggtgcaataaatagccacctttgcctgaccttaacctcacctaagcgccatgctcctcaagagccctgggcaccccaggagtaactgaaaacctttggaggagagttacgctggtgttcttgggttagaggcgggtggcaggctggagaattaggttggaaataaaaatgagtcagtgttggtgatgcgttttgtgaaaccggaaagcttagttagaatgatagagaatacataacctgttctcagcaactttgttttaactgacaacaggattttcccagttttcccactaatgtctcttttctgttctaggatccatctgggatccacattgcattttgtcatcagttcaccttggactcctccaatccatgacgatttctcagtatttacttgtcttcccgacctggtgcttttgaagagtagctcttaggtatcttgtagaatttggatttgtctgattagactgaagtcttggatttgggggaagaatcgcacaaaggtgaagcgccctttccctcacatcctacagggacacacggcaccaatgtggcttcttactgaggatgctgacctcgatcaccaggctgaggtggtgtctgcaggtttctcctctataaagttactgcttctccctctccctgctctggaagcaagtcactaggtccagcccacatccagggaagtggacttaggctgcccatcctggcaggaggaggatcaaagaattagtgggcctgaggttagaaccatcaccatcattagtaaatttggagagagatactcagaggctatgcagatatcctgtgtcaccctgacgtattcatccatggataggtcattcttcttttagtgtgagtatcaaaagcaggttattcggtgcaaccagtgaacttgagagcagggactgggaagccctggagttgtcgtggctcagccccgtgcccctggctgtgttccttccctcctcactgccaagatgctgctgagccctggtctcacaaacacctttgagtggtctgctcactgctggggacatggactccgacaccttcctacccctcaccgttcccctctcctccgacttgccaccgccaaagccagcagtgacaaaggaggtgccaggggcagctgctccagcaggagctctctctgtactccggaccctgacatggatgaaaacaagatatgcttgggagataattctgttaactttgtcttcttttgggaggtgtggtggctaaatacttgaatgaaggttttatgatgggtggaaagagtaacaactttcttcatcctaactcaatgtcactcttcatgatgtactcagttattcccttttagaaattatcttaaacaagggtgagcaatggaatgtgagaaagatcaaagaaatgcagagcagactaagaaagatgaaacatctggattgcagagaagggtgacctttccctagaaaatatcaacactaaatctttacaaagccctgtccactgggttctagggagcgctgcaaatggactggtccctaagctctggcctgcttctccactcctgtgagacagttaacttttttcttttccttagctctgttcctcgccgtggggactctggataacaacagacaacaacagagcccgtggtagcagcagcgaaggagttaatatgcaccatgtgtctaagcccttttcattttacttctttgtaaatttttaacatatttatttaaaacataaacatcgatattctgattagttcgcaggaacaattattgtcattagggaagatggaaatttactagctattttcctcctttcatttttaaaaaaaaatatatatgtattacatttttttcttcaacttttattttaagttcaggcatacatatgcaggctgtgcaggtttgttgcacaggtaaatgtgtgccaaggggatttgctgcacagatcatcctatcttccaggtattaagcccagcatccattagctattcttcctgatgctctccctccccaccccaccctccgacaagccccactgtgtgtgagaacatgcggtgtttggttttcctattctgcgttagtttgctgaggataatggaagccctttccttaactcattaaatgggtaaatgtttgcccccacaagcccgcattcgtattttgaagccctaacccccagtgtagctgtatttggagatggggtctctaagaaagtaattaaggttaaatgaggtcataagggtggggccctgatccaatagaattattgcccttgtaagaagagacaccagagagctcactctgcctccgcatgcacacacagtgtgggccgtgtgtgcacacagcgagaaggtggccgtctgcaagccaggaacttgctggcactttgatctggaatgttccagtctccaaagctctgagaagatacatttctgttgtttaagccacccagtctgtggtgttttgttacagcagcctaagcagactgagacaggcagatactatcattcccatatgaaaattgaagagactgaatcatagaaaggggtcgcttgctgtattgctctgttgatttttccttctaatagttttgctttctacatttactgtaatgttcagttcatcaaggctcctgaccatgatggtttgttgtaaacttccccacttaacagtatcctctgcttcctttttcctcatttgacgtttttcactttgaattctcctttctccaatgttagcatctgaaaccctttgtgttgggcaggataggccaagtctgatgctgttacaaacattctgaagacccataggcctacagtgaccacagcttctctcttgggcacactggaggccattggcggtgtgcagggcctctgcttactgtagtctcagtccctgcccaatgggacgtggctctcatggcttctgctgtcagcacagactcattcactggctcttaacacttctgcccagaagtggcacagatggtggaaaggtgccaggtgggctcctctagccaatgtgagggcctttgtacaaaggagaaaaggggaaaaagagcccacccactggtgcagggctaggagagtagagggtgtcccttccctcagatgggtgcccccccaccctgcagcagggttgagggagcagaagcggggtcctgccctgttgcctggtggccgggcactcgctgcatgcagggcggagggataaggagcagagtcctgccctgttgcccagtggccgggcaatcactgcacgcagggtggagggagcaggagcagggtcacgccctgtcaccccgtggccggccactcactgcaggcaggtggagggagcaggagcagggtcacgccctgtcaccccgtggccggccactcactgcaggcaggtggagggagcaggggcagggtcacgccctgtcgccctgtggccggccactcactgcacgcagggttttgctgtctttatgtcttcagggcatttccatgagaagtggaggctgctgccaagacagcatttcaaaccattcttgaagcaggaaccacatctgcgtgtgaatttttccagaatctgggggaagaacttacttgtttcttcgatattctaaataatcagtacagcttccgacagcagtggcctccaaacctgaaatagaggcagtgtatgagtccacgagtctttttgcttggttttgccttgcttgctttacttggattctgacactccactcgcgtgtttccacattcaattccatttgaatgactttggtgcttctcagccagctgtggacccggcagccctgagccctagcccttcccctagcagccaactcagcacccgtgttctaaggacgcaggagtctagaaatagctgcgattcagagcatgttttcccgacaactgctgattctctcctgacaccctaatgctgctctttccctattttagggattgttctttgctgaaattatgtggcacacatcaaaagtgttctacaagtgtccggggtgttcattgtaatctggtataacaagatgcctcacggccaggtgccgttggctcctgcttgtaatcccagtgctttgggaggccaaggtgggaggatcccttgaggccaggagtttgagaccagcctggtcaacgtaatgagacccccatctctacaagaaaaaaaaaaaagataccgcagttcacgcagttcaggtatttgttccgtgaacttgggggagtcatataaactcaacttttctttgtctctcttgcctgtgatgagtaacagaaaccatcttcccagaaactatccccacccacccccagcccagcccgagcagcccagacccaggaaggaggtcagagcctgcgtgactgtgtggcaaggatccccctcaaagcaggcagtgatccccctcaaagcaggcagtgatgaccaggctccccaggggaaggaaaaatggttgattaccccacctcactttctcaagttcctgaaagcctcccatcttttcaggatgttttccttctgcttcctttctggggtgatattgcaatgcatgtgtcagtcccattgttctagctgccttgaaggagttccagaaacaggcatggctggtgtgagaggaggcgtccttgtcaccatcctttgttgcctcccatctgtggtcagcacggaggctgccctgggtcttggccggcccctggagctggaggaggtgctgggccatggtttggaagctcgcatggtcccagcctcagagccccgttctctgtgacctggctgggtcaaagcctggccccagaacagcccctccctccccacccacagctgtgcccagctacgaacactgtaggccgggcgcgatggctcacacctgtaatcccagcactttgggaggccagggcgggcagataacttgaggtcaggagttcaagaccaacctggccaacatagtgaaaccccatctctactaaaaacacaaaaaattagccaggcatagtggtgggtgcctgtaatcccagctactggggaggctgaggcgggagaattgcttgagcccaggacgtggaggctgcagtgagccaagattgtgccattgcactccagcctgggcaaccaagagagattctgtctcaaaaaaaaagaacactgtggtgtgagaggcaattgtgggtcagcctgagggcacacccaatataactttcacaggtgttttgtttttctgagaagaaggtgacttttcccggttgctgtccatgcagactgtgagggatgttcacatgtcacatttctcaccggagtcctcgtcccatcgcctcctctctccctgccgcggttcggaagctccacgggggccagtgttgttcaggcctcaccagtccttggtcatgccacccgggctgagttcatttacctgctcattcatgtattcacttttcctccgattcaacaaaaaaaaaaattgattaccccccggcatgtcctaatatactgcagccttcgaaagagatgtagtcctcatctgaaaggtcatcctttcaagtgtccatccatccactgggcagatttttacttagcacattccctgtgctggggacttccccgggcactggggacactgtagtgcacaaaccgaagtccccacgctctgtgaccctgaagataaactgctgagcagacagctctgtaacatgccaagtgttggaaagggctccagaggaaatagggtggagagaggaacaagaagggcaagtggggaggttgctgttttctgtggggtgccagaggagggctcctgggaaaggtgatgttcatggcagtgggaaagacagcaggtgcaacagtggagaaggatgccagcctgacctgtctgactctcagcatgggggctgttgtggctgagcagagagatccgaaggaagagtggggagaaatgagggaggggagacagctgggggcgagactccctggggctgtgtaggcagcagtaagacttggattttccccctagcaagaggggtggctattggacagctcagacagaaacctggctgctctggcctgtgttaagaggattcctcctcgcactgtgtggaggacagccctggatggccgggcaggttacgcactgcagaagccctgggagcacccttcacactgactcctgtgtgaatgaccatcacagcctgggcggggctggctgtaggagcagcagaccagcaggggcaagagcagaagccagagaccaggctggacgttggcacagtgaccgcaggagagaagaatgttgccagaccagagtggagccatgggctgcagaggtggagaagtatttgcattctgtatgccttctgcaagtagagcctgtggggtttgctgatggattgaatatgggatgggagagagagggagatcaaagatggtcccggggttttcccctgcatgaccaaagtggatgttgaggtttgacctgtgccagtgtgggaagctgggtaaatgtcgggttctggggggaaacctggttgcctctgctgggcactcggccctcaggcctccacatcctccttgaaatgcgtatcgggtcactctggggtatgggtttctgattaggggagttcagaggcttattcacagcccctaaggtatagactaaaattaatttatgtaacatgtatcatactctttaagttggaggttttaaaaatgaattttaatttaaaaattgtcaaacataccccaaattagagaggctagtacgaagaacacctatacatctgtcacccagattcaacaaggttttaccatattgctttacctggctctttctttctttttctgggtgtctttgctcacagtattttgaagcacattccaggtgcagggtcacctcgcttttcagtgtgcacatctaaagcagcactgtgttctcacacaaccacaatgctttcacatctaatcaaattcacttgaattccttggtatcatctaatatctaaaacataataaacttttttccaattatgtcaaaaagtgtcatattacaattggttggtttgaatcaggatctagagagtccacgcatcatgtctgggtgttctgcctcctacacctccttccatctgggaagctccctccctgccatgttgctgtggaaaccaaggcactggatcagtagagcaccctacagtctggctgcttgcttccctccagtgtcatttcacttgttcctctctcctctgtatttcctgtaagtgaaaattagctctaggacagtgctgttagaaatgtaatatgagccacatatgtaatttaaaattttatattagccacatttttaaaaagcgaaatgcataaaatctattttaataatatattttatgtaaattgatacatcaaaagagcatttcagcatgtaatcaatataaaaaattgttaatgagagatgttacactctttttattgcattaagcctttggaatctggcatgtactttgcacgggtagcctctcagctttagttcacaggctcgggcgctgcccgtggctgcattgggctgtgcagctccagcgtctccaccagattctggcgtaccttttgctcctaggtggtgctgtgtgcttcctgttgtgtggcactgggaggccctcagtggtcgtcccatgtttagtgaaaagtaggtgcaggtggtgacggcggatctttccatcataaacttgtccatcatgaaagcagtggcgcccccactctctggatggagaagactggagagaagtcagggaattaaaagccccaacttgcaccttacctttcaagttcctatttgacatccacagggaaaaataaactacacagttggatctgagtctggaattcaagatctgagctggagatataaatttgggagttgtcagtgtgtcaatgatgtgaacacggctggatgagatcaccaagggcaccagtgccagtgccgagaggtcacagagatgcagaaccagcaaagggagttggacattgtcccagaggccaagtgagatgagaagtgccaaatggatataaaggttacagcaaccttgatgagagctggttcagtggagtaatgcggtgagcacctggttgatgtaggttcaagagaggagattcctcaaaaaagtgaaatagaattaccatataatttggcagttgtacttctgagtgttcaccgaaaagacctaaaagcagtgtctcaaagaggtacttgtacagcagtgttcatagcagcatatacactagcaacaaactatccaaaaaagaaatcaagaaaacaatcttggctgggcacagtggctcacacctgtaatcccagcatttggggaggccaaggagagaggactgcctgatctcaggttgagaatgttgtgagccatgatcgtgccactgcactccagcctgggctacagagtgagaccctgttatgtggtttggccctgtgtccccacccaaatctcatgttgaattatgatctttgtgttgggggaggagcctgatgggaggtaattggatcatgggggcagatttctccctttctgttcttgtgatagtgagttctcccgagatctggttgtttaaaagtgtgtagcacttcccccttcactctctctctcctgccgccatgtgaaagtgcttgcttcccctttacccttccaccatgattgtaagtttcctgagacctccccagccatgcttcctgtatagcctgtggaactgtgaatcaattaaatctcttttcttcataaattacccagtcccaggtaactgtttatatcagtgtgagaacagagtaatacaccctgtctcaaaaaagaaaaataaagaaaagaatcccatttacaatagctacaaaaaaagcactttaggattaaatgtaaacaaggaggtgaaggatctgtacattaagaactacaaaacatgatgaaaaaaattgaaagagacacaaataaatgtgaagatatcccatgttcatggactggaagaattaatattgttaaaatgcccatgctacccaaagcaatctacagattcaatgcagtccctatcaaaactccaatgacattgctcacaaaaatagaaaaaataaaataaaatttgtaccaaatcagaaaagactcctaatagtcaaagcaatcttgagcaataagaacaaagctggagacatcacactacctgattccaaaatctaatgcaaagctgtaaccatcaaaacagcatggtactggcataaacagaaacaggtggaccagtggaagaatagcgagcccagaaataaatccacgcatttccagtcgattgttttttgacacagttgccaagatcacactatggggaaaggataatctcctcaataagtgatgttggggaaaactgtccacctgcagaagaatgaaattagaccctcatctcattccatataaaaaaatcaactcaaaatgtattaaagacttaaatgtaagacctgaaactataaaactagtaggagaaaacataaggcgaaagctccatgatattgttccaaaaacaatgatttttttggatatgactcaagagcacaggcaacaaaagaaaaaacagacaaacgggattgcactaaactaaaaagcctctgcacagcaatggaaacaacagagtaaaatgacaaactaacctacggaatgggagaaaatatttgtaaactgtgcatctgttaaggggttaatatccaaaataaacagtaaatataaacaaattaatagcaagaaaacaaataacctggttttaaaatggacaaaggacccaaataggcatttttcaaaagaagacatacaaatggccaatagatacgtgaaaaaaaaatgcttgacatcattaatcatcagggaaatgcaaattaaaaccacaataagatatcatctcacacctgttagaatggctatgatcaaaatgaaaagagataacaagtgtcacaggaaatgtggagaaaagggaaccatcgtacactgttggtgggaatgtaaatcagtacagccattgtagaaaacagtatggaaattcctcagaaaattaagaagaaaactactatatgatacagtgatcccacttctgggtatgtctccaaaggatatgaaatcagtatgttgaaaatattccttttttttttttttgagacagaatctcactctgtcactcaggctggagtgcaatggcgcaatctctgctcactgcaacctccgcctcacgggttcaagtgattctcctgcctcagcctcccgagtagctgggattacaggcacctgccagcacgcctggctactttttgtatttttagtagagatgggttttcaccatgttggccaggctggtttcgaactcctgacctccagtgatcccctgccttggcctcccaaagtgctgggattacaggcgtgagccaccactcccggcctgttgaaaatatatctacactcccacattccctgcagcactattcacaataaccaagatatggaatcaacctaagtgtctaacaacagatgaatagataaagaaaatgtggtatcgagacacaatggagtactcttcagccttcaacatgaaggagatcctgtcattttcaacagcatggaggaatctggaagacactatgatatgtcaaataaaccaggcacagaaagacgaataccacgtgatctcacttcttttttttttttttttttttttttttgagacggagtctcgctctgtcgcccaggctggagtgcagtggcgggatctaggctcactgtaagcttcgcctcccaggttcccaccattctcctgcctcagcctcccgagtagctgggactacaggcatgcatcaccatgcccagctaatttttgtattttttgtaaagttgggtttcaccgtgtttgccaggctggtctcaaattcctgacctcaaatgatctgcccacctcagcctcccaaagtgctgggattacagacatgagccactgcacccagccgtcactcatcttctaatggaaagaatttgcatttataaaagaaggattgacatttgtaatttttctaagaaatggaatttacagtgccaatatagatgactctcaaatctcacatcgctgagtgctaagtgaacttcctgttgctgtgaaagttagctacaaatctgtcatatttgaagtgagttagaaagcatgtggggaagattgactacatctcctgaatccactaaagctgatttgggtgctcgttttgtgattggatatatataggacatctttttaactccctaatatgatataaccaaaaccagttctctgtattctctgtagaaaacaacacgacaggccagtgttgactgaaacccaaccacatgaacaaaaagggcaaagcccaacgctgttaaccctcaatggagataattaaagacaaaacaagagaaatactgctttatttcttactaggctgctaatgaaaaagactcacaattccacaaacagggtggacatcgctttccagtttactcttatcttttgaaatgtgagttattggttcccagtttgagatttattcactgaatcaactgtcagtcttttcattggggttattttcattttgtttcattttgattttgaccttaacttctggaaactataattggggaataaaaggtaaggggtgtctcctgataggaattacatatgtaacgtaaatatatagatacatctatctatctatatgtaaggtggcaatgcatatatgtatttaaaaaactaaataaaacaaaaccaagattgtctaggcaaatcagtgctatgtatagaatttctctttggttatttgggattgtaatcttgtctttatgcaattcaggattacactgagaaaaattaaagaaaatgtcaaaagctattatactgggcaggggtagggcatgagtttaaagatatttgagtattttcaatatatccaaatcatatgtatgcatttgtttctgcccaatttgtgaaatatatggtttatcatgtctatctaaatacttgctgaggaaggtaagttaactagtatttactgagcaactgtataggtaggattttgtctcaatttccaagcagtggttcttggctgtggccctgagctctctcaagaacatggtgcctggtattcctgcgtgcacactgagcattgtctaggacagagcaccaaatattttatggaatatccatgtgactcacgtatgattattcataaattacacattaactaccacaatagaagttaattcattgtacaatataaacaaaagtaaatttaaagaggcaaaaaatataatcagaagagcatgcattttacttcagagaactagacaaaaattaaatgtgccttgtgtcagtatgtatttttactttttaaacatttgtaagtactatttgtgattaataaaatgcaactgctcctaaaaacattactgaatttatatgtcaatggaagttcactaatataatgtgacattctgtggaattttacaatgttacgaagataacataattcatgatagaaaaccactattctaagattttcatcttcatcaaagtaaacttacccatgaaggggcattttctgaagaagagcccccaaacccttgtttgcagtggtgggaaaaggctggcggtggtagggggcatccttgcaccattttggtttcagttacagtggagctgaggttggatgaagaatcacagaaacaggtcaagtgtgaggatgcacgtaccagccaggcaggggagcgaagacagaaatgggaaacaggagcaaaatgaaacagaaataaagagaggaaaataatttaacagtgagtagacaggcaaaggcaacatatgtaaaattggagtattctaagaggaaaacctaaataaatggaacaatgaatattttcacatatgaattaataaggcattccataaagaagagtcgaatctccaccatgccccagaaaacatagagatagtacagtcactactgaaacagtctaatcgtgttttcagatggccatgataaagaggttcttgagaagacaggcaaaaaacaacaacaacaacaacaaatcaagatcaaatgggaaaatatccaacctggcctcaatttctccgtggcaacattcactattagaagaaagttatggcaatgtctacaaagccttaaggaaagaaagcgtgacagaattgttcacgcttcaaactgtcattcaaaaataaaagaggagaaaaatatatttgtttatataggcatataattccctagaaggatatgtaaaaaaatgaaattccatttttaaaaaatgcaaggattcaggaatatcgtccccataattccttcttgaataaactattgaagacaatgtcttccacctgacattgttccatggaatcactgagatcctttatgaacctgtaggctcaagccacagcccatatgaattaaattagaagctcggtgatagcactgaattatcaatacttttttaaaccccaaggttcagaacgagtgcaaccaagagataagtgaaagaagtacacaagagaactggcaatgagcgttatttaactgtgggactaagacaagcatggaaatcctaaaaccaaggagaaccacctaaaaaactgtgacaaacagtacaaggatttaggaaggcagctgggtataagctactgcccagaaatcaatagcctccatatattcatgcaataaccagttagaagacagaatggaagaaaaggcttcatatcaatagctataaaatatataaaataccaaggaataaggttggcatgagtgcaatttatataaagaaatctttaaaacactactgagaaaccaaaactttcaacagcagaaatggcataccatgttcttggataagatgacttaacactataaaaatatcaaacctcaccaagtttatctacataatgcaggtcccaataaaaatattaatagaatttcttttggtaccagatagcctggttctaaaacttgtatggaaaaattaacaagcaataataaccaagaaattttttcaaaaagattagtagggggctgtgcattaatctgttttcatactactgtaaagaactgcccaagactgggtaatttataaaggaaagaggtttaattgactcacagttcagcatagctggagaggcctcaggaaacttaaaatcatggcagaagatgaaggggaaccaaggcaccttcttcacaaggcggcaggaaggaggagtgccgagtgaaggaggaagaaccccttataaaaccatcagatcttatgagaactcactcactatcaccagaacagcatgcggggaactgccctcctgtttcaattaccaccacctggtctctcctttgacatgcggagattatggggattatggagattacaatccaagatgagatttgggtggggacacaaagcctaaccatatcagtgtggttagcctgaaggtatgaaaatattataagtctgtaattaataaaactatatggtactagcacatctcatgaacaggcaggtcaatggtacaaaacggaaaatgcagaagtagatccaaataaatgatgaacttttctatacagtaaaaggggcatttcaaaccagtgggaaaagataagttattattattattattatatctttttttaatgagacagggtctcgttccctcacccaggctaaagtgcagtggtgccatcacagcttactgcagcctcagattcctgggctcaagcaatcctcctgccacagcctcccaagtagctggtgctacaggaacacaccactacactcggcaaatttttttttatttttagtagagatgatgtctccctatgttgcccaggcttgtctcaaactcctggcctcaagcaatcctcctgccccgacctcccaaagtgctgggattacaggcaagagccactgtgccaggcagaaaaggatatgttattaaagaacagtttggggacagagagcaaaccatgtggaatacactaagttaatgcttcatacctcataccaaaataaattacaagaaagtcaaaagctggcaaatggaaccacaaaacaacaagaagaaatcaatttttaccaaaaaaactatatataattttatatatatttatattatatatgtttataatatatttatataatgtatattatatatttttatatacatataaatatatatattttagagacagagtcttgctctgttgcctaggctagagtacagcggtgcgatcattgctcatcgctgcctcgctcctgggctcaaggggtccagccacctcagcttcccaagtagctgggactgcaggcatgtgccaccacgcccagctaattttccttttttgtagagatggggtctcactatcttacccagcctggtgtcaaactcctggcctcaagcaatcctctcccctcagcctcccaaagtgttggtattacaggcgtgagccaccgcaagtggccgagaagtttaagataatattggaaaatatttcgtgtaagttacaaatcccataagttaccccagaaaagatgtttagctttgtcttacatagacattaaaatatttataaaggcaaaagccaatgttaaggtcaaaaggcagcaaacagggaaaaaatataatatttgcaacttgtgtcactaaaactaattttcacaagaggaactctaaaaagttattaagaaggccaatgatacgcgagaaggcaaaagaaataaaatagtttgttaaaaacaaaaggaactacacatggctctaaaacagaaagaagtccaaacttcacacatattagaagtattcattaaaactactctaggttaccatctgcccaccccacgccccagcacactagcagggattaggagatggcttggcaactcactgcgtagtgtagatatggggacatagggacccctgtgctgatgagagagtccacagcagctatctccacagagtacagctggccagtgtaggtttggggacatagggacccccacagtgctgatgagagagtccacagcagctatctctgcagagtacagctggccagcatctgtccacttcaaaaggcacatgctgtttaacccggaagttctacctctgggaatttatcttgcacctctactcccatgatatgaaattccaagtcatttgctgcagtcttgcttgtagcagaaaaatgtggaaacaaacaaatttgtctgccataaaggactggtcaaacctgttgccatccatacaaggagtgccacgagctcctgtgcacctgtggaaggagctctgagctagattgtttagcaagaaaagcttcaacacacaagttcagtgaaaaaagcaagggcagaacagcgcacggtgctacatgtctgtggcagaaaaagggagaaaagcatgcgtttttgagtttatatattccatcaccttcaatatacagcgtcgggacacctgaccacctgcaggacccactgtcatcctgggagagggaggaggaagctctcggatctcctcttgtgaaagaggcgagattattgctcagcctggctccagaggcacgcagtccctgtgccccgagaaactaacatgccatctctgctctcccaccgcttcctgggttgggctgcggggagaggccttgctacagtgggtgcctcatcagcactgtgaacaaacagggaaggatatctggggccacgcagggagaccctgggggatcctgggcagaagcccctgaagtgattgagctgtttcctgggccctctgatgattctccctctgccttggaggcttggcttcccctggctgctgctaattctggaggacacagtggggtgggccacataatggaggctggactgtgtgtccagtccacccagatgccaccatgcctgccagtccctctcctccttagagcacaagccctctgatgctcccagacagtggaaactttttgttccccaaagccctccagctggccgggctgccctccccagactccctccttccttccagatgtgagcaaatccctttccttccacctcgctctcggcccctggttcaccttctgttcctgcccagggcaaactgccctatgtgcatctctgtcctcatccatgaaaccatccttgtcctcactgtcgatggaatttttcagtgatacctaacatctgtcccagagccatgcacgttccgaaagcacattccagggggacagttgtgtccctggtgcaacacgggagtgggcacacattctctgtgctgtgcatggggacagctccaggaagagagagggcactgttttcctgtttcctgagtcaatccgctgtagttctgtggcccagctgagtggcataggctctcctgacccaggtacctatcagcccccaaaataggtgttgccatgattcctttggacaaaatgtaaaatctggctgaagactgagtcctcgtgcacctagcgtgacccatgacagcatgcaggtgttggtctgtagggatgccataacaaagtgccacaaactgggtgacttaaaataacagaactgtattctctcacagttccggagaccggaagtccaaagtcgaggtattgggccaggtgggttccttctggaggctctgaggggaaggtgttccaggcgtctctccagcttctggtgctgctggcagccctcggccctctggcttgtagacacatcacaccaggctctgcctccgtctccacgtggccccctccctgggtatttgtgtctctgtgtgcaaatttctgtttccttataagaaagtcattgaatgagggcccaccctaatctagtacgacctcatcttaacttgattgtacacgcaaaaagcctatgtccaaataaggccccatccacgggttctgggtggacatgaacttttgggggatgttactgaacgcagtgcagggttcttacattctcaccatcacgtatatgattttattcttcagggtgctaaggtgtggtgtgtgccatgtgctcttaaccccttagaaaagataaggacaatttttttttcaggtccaatgtctgaatgtattttttttctttctcttaggatttgaagatatataacaatatgtcataaactgacctgaaatccttgtttgttccgcagcgaaatccattaataatccctataactgggacagttttatgttcccattctcggtgtggctatttatagtgaaacctcactttccctgtgttggttaacattaaaaactggaactgcttctgaggtaggaggcgggacttgactccagaggcggggcttggacactgggccagattgaggactagctaaaacaggcccggtggggaaagcagtcttcaatcagacacgcccaccagcgctatgtcaatttaccgttgccatgacggcacccaggcattaccgctcctttccacggcaatgacccagtgattactacctcttccttgcataaaccgctccttaatctgcatgcaattacaagtgagtataaacaggactgcaaaactgccctgaggtgctgctctctgcctgcggggtagccctgccctgcgggagccggcagggagctggaacactgacacttcagtaaagctgttttcttctacctatgacttgcccttgaattctttcctgagcaaggccaagaacccagatgggctaagctccactttagggctcgcctgccctgcatcagtttaactaaactattagaatttttagtttaaaagaaatgagtaagattgtgagcattctgtgagatgcggagtgaaagaaggtgctgtagtctgaacgtttgtgtctcccctaaattcatgtatagaaatcctaaccaccaagctgactgtattaggaggtgggagcttttaggaggtgattagggcatgagagtaaatgagattagtgcccttataaaacaaacccggggagttctttccccccccatcccgccatgtgaggacacaatgggaagggggccctcaccccttctatgaacaagaaagggggccctccccagacactgaatctgctggcaccttgatcttgggcttcacagcctctggaactgggggaagttaatttctgttgtttataagccacctagtctatgcccttctgctacagcagcctaaacagctcagccttaatggacgaggcacatggaatgacttccgggcctctgacagggtgcttggggaggatggtgtgatgttgcgttatcactcacagacactgtggaactgactgggttggtggagcggggacccggggaagagttcagttctgttctgggaatgttgccttgaggcagctgagcactacccacagggaaaggtctggcaaaggttcacgtgcattcgcctgggccataggggagaggggagccgtcagcggtcagggtggtcaaagccacatagttgcatgaggtctcctaagtaggtcagtggagcagagtacccagggtggagccccgggaacctcagaaacaaggaaggggtgagcagaggaagggtcgccctcagggcactgggagggaggagcagggtgaagggtgggggcagaggggaaacagccatgtccatgctgcagagagacccaagggagacccggggaagaatgtcacttgcaccttgcaaaagggagggtcctggcggcctcagccagagccgttttagtgaagtcatggggagaaggaccacagaggcttagtcctggctggggccgcagtgggactggcagtggagaggagggggcccaagccagggagattgagttcttggcaaagaggccggcggcgttctccactgcgtttccatccgcaggtgcgcctgccgcctggcctgtccacagtgtgctggttgctggtattcagttctggattgtacctctgactggactgaggtccatcagcaaatgacggggcctcggcggtgtggcagtgtgttcagctgctggcatgccgcctcgggaacagaaaagtcacgttgttgtgtatgcgggtaacagctccagggaggcgtgaagagaacttcctggcaaggagtgctgctccaagactgaatggactttttttgaagtgcaagggtctggcctctggaagggtgtttttgctgccacctttgaacttctctgtgagtttttaaattttgagcaaatcgccttttataatcattctatatgtactttttctacccaacggctgcatagtgttctcttcccacagctgatgtacttaagccccatccttctctggtataaagaacgttgcgatgaacatccactggcaatcatcttcctactcatctttgattgttgctagaagggaaattgctgggttcaaaggatgctgaccacttgttaagactcctggagcacccagatttccatccttcttaatctcgtgttccattacattgcagaatgtagtgacagccaagaatttccattcataaaactcaatgtagggttttctttggaagctaacaaatgacttcaggcttgtcatcagaccattgcactgtgctgactctgaagaatttgtaagttcttcacatcactttaagaatacttataattttacttattcatgaaagcatttaaataagcttcttactattaaataatttcttattgtgaaataaaccatttacttcattaacttatgttttttaaaatcaatgaaactaaaattctaaggttaaagaaaaaattctaaggttaaagtaaaatacaatagtaatttagcttaaaaaaagaaaaaatgctgattttcttatttactgatgtgaattctcaagatgtttttgtattacttattgaaataatgttaatttctgagcctgtgattttgaacaaaacatgtataattgaagtaatctataatctgtgaaacaggtatctcaatttttctcaaaggttttaattagaaagtcagggttggaatccactcttcacgtaagaatgagatggtttccagagataccaacaagccaacacatcttaatttgatgcctttttattatcagcaaaatatttaaaattggggttttattctgagtaacttatttcatgctatgaaactgccaaaaacaactacaaaaataaaatgaatttatgttctttataaaatgttattaatatgaaaaccggacactatgtgaaagcgatattgtgtttatgtagggagagtgtgttaacatttttttcagcatggctgagttggctgtttttgaatttgaaacttctgcagtctgggtagacagtgccacctccctgcagcaaacatgggcatcccttactgttctgaagaccctcaagctgcagtcaacactggggtcgtttgtggaaggattctttcttgctgtcttgatttgcaagaacacctctgaaggtctttgaatagtaaatgctgtttccatggcaactgcagtctggcttcagtgatcccttaacctgtgtgcctttggctcaaagcacccaggagctcacggccttccccaggggcgtccccctcggtcctgttcacaagcatggactctggcatggacggccccaccctggctgcaccaccgattgtccacatgacctcaagcaggttatttggcctttctgtgccttccttggaaaaatgggtctaatacgtgggcttgttttaagaattaataagagaactggcacacagcactcggcacagtgcctggcacatggaaagctcttgagtcgggctccatcccccaaatcgagcacctcagttgtctgtaaatgggcgcattggcagtcctgtgcagcaatgcaagatattcttggtttttggtttcttttaaattctttttaggtttcttttaaaatgatcagcagtctttgatgatttatgagcctgtgattttgaacaaaacatgtataactgaagtaatctataactgtgaaacacagggatcccaatttttctcaaaggttttaattagagtcagggttggaatccactcttcacctaagaatgagttgcttcccagaggtaccaacaagccaacatgtctttggtatgttattcttcttgctcctcttcttgggtgtggggattttcatctcttcctggagacagggaggccctgagaggtctcggtggtgacgggttgcaggcaagaggagtgaagcaaaccctgctggtactgcagaagccacacggagtgaagagacatgtccttgacgtcatagagtggagtgcgctttctttcttttgttctttcgttctttcattctttctctttctttctctctttctctctgtctctttctttctctttctctttctttctctttctttctttccctccctgccttcctgccttcttttttctttctttctttctttcttctctttctctcgctctgttcctttcttttttccctccctgccttcctgctttctttctttctttctttctttctttctttttctttctttctttctttcttgttaaatccatatcacaaagcattttcacagatagcttgtttctagttgttttttttttcactttaagttctgggataggtgtgaagaacatgcaggtttgttacataggtctacacgtgccacggtggtttgctgcacctgtcaacccatcatctagattttcagccccgcatgctttaggtatttgtcctaatgctctcccttcccttccccctgacctcctgacaggccctggtaagtgttgttcccctccctgtgaccatgtgctttcactgttcacctcccacttatgagtgagaacatgtggtgttctgttcaccattcactcagagaacatgttggttttctgttcgtgtgttagtttgctgagaattgtggcttccggcttcatccatgtccctgcaaaggacattaactcattcttttttatggttgcatagtattccatggtgtctatgtgccacattttctttatccagtctatcattgatgggcatttgggttgattccaagtctttgctattgtaaatagtgctgcagtaaacatacgtgtgcacatgtctttacagtagaatgatttataatcctttgggtatatacccagtaatgggattggtgggtcaaacggtatttctggttctagatccctgaggaatccccacactgtcttccacaatggttgaactaatttacactcccaccaacagtgtcaaagcatggagcacacgtttgttcattcattgaccgttccctgtgtgtggctttcatagtattcatttgggatcctgacgtgaaatggcctaaccagggtggagtggcagttgtgttcccggcacaggactggcccagcccccgagccctgtagcttccctaacaccattcactcaggctccgtcagcctctcccgggttcctgggcttctctgcttgttttcatgaggtttgcgcctttctcctatgccaatttacagtacaccctttagcagctgcagccacatttggctttacaacccctggatgccctcatgtcctgcccagacccttcttttgaactccacctgacaacttgacacccccctttccccaacactcttcatcaccctgccagcagctgctcctcctgcatttctcatccccccacctcagagctgcctgagccggggctcccccgagcttgttcccctcccctcctcggtgaaatcgtgaagctggctgaggcccctcccctcacatagtgacctcggcagcctcccagtccatctgcttccaagattggccccaccacacctgcatcttcatcttggtgtcctagtgatcctaggacatgccagccttgggattgaaaacagcagcctctctccccaggacaaggccccgtcacagctgtccctgtgcctgtcatcatggccccctgaaataaagtctgccttaccatcttcacaaaaggagaaagaaaacacaaccctcatgctatggttccccgccttaccatccttaatgactcccatagcttccgggatacattttaaagccatatgatggcaccaggggcctcttagccccctccttcctgcctctctcccatgggggtcttacactccagttgtaccgagctactgaagagcgtttcccatcattttccatccttccagcctcagttccccctcctccaggaagccctccctgacttcctcggctggggtaggaacattcacactagctgcttattatcctcacagcatttttcctgaggtttagcttacaagaagtctttctgttgaataaatgaagaaatcagcaacaagggtaattgttgctgaaagaaaatatttattatattaaacgtaatacatgtttattatagaaaaataataaggaaaattcaggcaatagtagaaaataaaaattatgcctcatacttgaccaagcacaatacctgttaacattttgtttatttttctccattcttttatctgtgacttttttttaacatagtctcaattatgtgtctctaaatagcgcatttttaaaatctcctttttttaaggaaagaaataagcgtaactcttgtatcaaatgctctgtaaaaatgttttaatggccacaaaatatggctttgaggatgcaccatcacgtcctcacttccgtattgctggacactgaggcttttgtgtttgtttactgcggtgaatagcattgcagtgaacatctttaagagtgaggtttttctacttcaaattatttccttaaattagaatattagaagtgcaatttaaaccccaaacctacaaacacggttaaggacctggagctttgctttcctgaaagggtgtatcagtttacacttgcatttgtgttgtctgagagtgtcttgttcatcacaggattaagtactgtgattatctcagctttgtaaatttgacagctaaaaactggcagctaactgattcttaggtatctcaagttctttttcaaatcgtcaaaacgtgtcttagagtgagtgttgatattttcttgctgatttgtggattgcttattaacctttttcatagttgttgcaaatattttttttcagtttagattaggaactgaatatcttcctcatgtctttaaagaaatatgcctgaccaggtgcttgataaccctaaacggagtttcctgccgggctttctcttgtatgatgttgaggccgtcacggtttgttgagcagaggagtgagtgctaaaagctggagttcagcagaaccacagtgatgcctccaccccgggtaaatgcttaaccacactcctccctgtaaaaataacggtgtcattaaacatggaccggctgttccatgagctcattcctaggaaacagtggctgagtagcagaagcctgaccggtctccatttccgcccaaatgtgggatgtgtgcacgtggcatagagcctcgcacgttgcttttgggagaatcagcttgagtcaacttctggcaaaagattggggccgtctttggacagatttgaatattagacaccatatcatctaatgaaaaccagctgggaagagtcagttttcctgtgttcttgggcatttgacaaatggtgggagatagttctaattttagaaaggaaaacgtaatgcatattctcatgatgatttgtcaactggatattttgcagagaggaaaacgtctgaaatgtcccaaataaagctatctgctgtcatgagaacacagctggcagggcagaaagcagtgtcgatcaacaggaggtcgtcctgcaccgggacgtcagtgccccgacacctcggtgtgtcccttggctgtgtggccttgggcaggtcactggtcaagcctgagataatgacattggtctgctggggagcagcggccctaggccagatgtactaggaggccccttcctggctgtgattttaagatggaggggaaaatgtttatttgttctgtgaaagccaggggtggggtaggacagagccagcaacaccgacagcccatcatgctgagccagaggtctgctgagctgaattgaagctgtgtcaactacagtacgtgcctcaccgagcctcagtttccacattggtgctgtgcagatgataatacagactttgcaaggctgttgagacttacctgcactaagacatagaaagtgcccaacacagcgcctgcagggccagcactcggtggcagtctaaggaatgtctgtcacagcgctcccagatggcaggtcctgcctgcctgggcccagctctggctgtgtggctcaggactatgggacctctgcaggctgcgtcccctgcctgcctcagtttctgcgtctaagctagaaagcatgattgttcctccccgtggggccgttacgagaagcaagcacatggaagcgtgccaggcattttccgaacgtctggaacatcctcagcggcagggtctcctcctccctctcctcctcctcacttagaaatattttccctgggagtcccacggaggtcgtgaagatgacagaggctgctggcactaacagctgtgtggggcagcccaagcccctactttgaaagttccattccatccctcgcatttcatctgaagagcgctatgttctccctggggagaactggcctgttgcatatgaagagtccagagattttgaacaagggaaccccttcagcttcgaatgaccattaccgttgatgatcccagaagttccctttccaagcagtgacccatggacttgtgtccctcgtgtgataacctgcactacacacatatcctacaagtgtccatagtggttataagctgccacagccatacagatctgagagccagaggccttcaaaccagctaaggctctgaaacacttcaactccacttaagaaaacaaatcggagcacatccgtgatcccacaaatgctaatttgcttgtcacacatcagaaacccaggaaggcacagaatagatgctctcttactggcttataggttgggtactttaaagttggagacgtttaaatcagagataaacctattgtaacaatacatttcatgtcatgtgagccttttgtcttccagcaactaaagggaactgtggtaggatgagctggggtcacagggacaaggaagacaggtaaggggacggaagccggggcagcaaggagtggctcaggagctctcaccctgcagtgggcagctcatcacccctgctccccgtgtctgtgtcccttcaggagaagctggccagggacagggccaccactcatagacagctcctcagcctactcagcactgctttatgtgtctgtgtgcacacacgtgtgcatgcctgtgtgtgtgcaggtgtgtgtgtgcctgcatgtgtgtgtgcacatgtgtgtgtgtgcctgcatgcatgtgtgtgtctgtgtattccttttgaaacatactagatgccctctctaagtaaatcacatttaactgctgtaactaacccgtctggcaacatcttttcttaatgctttttcactgttcaccgggttgagggtttcttttccttatttccacttctgcttctttaacgaaattatatgacttgatacagtatcattcttttcaaattcagtgtttcagtaaatagttcttttcagcagacaattacttaggcagaagtagtttaacatagcatttgtctctgaaaaaaatgttttttttcctttctgtctagatcctttaaaatatataatattgcatcatatacaatattggcctgtaccaagcacctgtatccagaaaagtaaaaaagctaactggcttaaaccacagcagaacctgccttgctgggtcaccttccttcagttccttctcatggtttctagaattccttgagcgcacacagcaagctagctctacaatcactttagagagtgaggatcgatgccccagcttcttgttttcttagtggctttttaaaaaatagtagacagtatatagctatctactggcaataggaatctcttaaaatcaaggtgagaaatgtagttcttttgcaagagagtcagagttttgtgttcaatgaaaatttaatatttgaaaaataaaagatcttaaaactattagttttccattatgatcagatggctctgtcaaaatggaaagaaagcagggaattttctgtactcctcaacacaaagtttatcttgttcctgaaaaaatattgaaccattttttcaatatttgtccttgccaggatttcaccctggcacccgctgttggtgtgttttaaatttggtttccttctgattcttctaagagaatatctactttatcatattttgaaataagactttacagtatccaaatgtggatgatatatccttttaactatgtccctgatattgaagctctgaacataacctctcaatttgagtcatctgtgtttccaggtattgctatagctaagccacaaaatactgaattttggcgtcttatatagatggttgcagtgtttccattcttcacgaagcatgagaaattcttttacaatacgatgaccgtgctccgtcgttttaggcgaagaacagacttaccacacactgtgctttctctcactttgtgagacagtgaaggagggaccttctcttcaggtgaaatgaaacccccacacggattagcctaacttcttcagctaagggctgggccttcttttattacaaataccgttgcatctttatacactgtttcagtgaaaaaaaaataaacatggcaattccctttccaaggctctaagtcaccaccaggcggcataacagacctctgtgtccctggtctgtaggagatgggacaatgcggggacagcgctgggagggcccgcaggcagcaggatgccagggcctcgccaggaagccatggtaggcgcccggggggagtctggacgtcaccccattctcaaggtgaagcctcgccagggtctcgccaagagagctgaggggtcagattcaccttctccctgcacctctgcacttccctctgggtttcctgtctgtacatccagtgccgcgcgtggcgtggggcgtggcgtggggtggttcctcacagttaccctcgctgggtgtgcggttgtctgacatcagtcctccccagaaagtgcggctgcccccggtcggtcgttctgtctgtagctggcgtggtatctggcacggcggaggccctgggtccgtgtttgtggatggaatgaatcaatgtgtgaatgaaggaagtcacattggcagcagtggcggggagggtaccgtttggggacaattcagatcattctgaggagacatgctgaggcctgctctaagacagcagctgtgggagggcacggagtggcattaagagaggaagctgactcgatgacgggcggagaggtgggcggaggctgtctcaggagcgccagcagctggcagtgagtggtgggcgtttcctgacactaaggctctgtgcagagcgcgtctacaaacactgtctattgtctcgtttcatcctcacaacaaccacccctatgaagttgtcactattattgtctctcctttacacatgagtctgggcacagggacttcaagtgaagcctgctaggaggcactgctgctgcccccgcgggaaggaaatgcagggaagggactcagggggcagcaggaattctgctttggatctgtcacatttgaggtgcctttggggcttccaggaagaggtgtccagacggcaggggctgaggcttggaggagtcaggattggaaatatgaactgggtgcccatcaacatctaggtcgtggtcaaagtgggtggtggggtattacaggaaagagctctgcagccccccagaatcctagcctgcgcccgcagatgagcaggggcaaggacgcaagggcagttgtgcattttccttcttttctgtggcattcagaaataggcaaaatgtgatacactgcaaaagtgactgtttgctatctgcaggagtggccatcagtgttagttaaatgagagctgtgcagaatggcatgtgtttgtcctcttattatttttgctttaaaaacctgttttaaaaccctggtatcaatggtcaattatgtgactttcaaaagcaaaaattaaggaagacaaaagaactgcatttgacaccttgaaaggcccagagggattcttaaccttgggtccaagaattcccccaggggcctttggatagatttccagagatccccgaaactgaataggaataaaagggtagcattaccttccattatgaatgcgggcaaaaaccttcggtagtattagaagtgtgacctcagcaccaatagaaaccacaggtatttctccgtcactttcgggttgttgctgagagctggggaaatggtttcatgcatcactgtcagtatttggtggaataaggacgtgcacgcacgtgctggctgttgaactgttgcctctccactgcaaaccctcccttccttgctgcagggccagagctgtgccctatcgggccctgcccccagagagagcctgggcagtgggaggagggagcccggagcacgctgcttcctgcctgcttcctgtttctgtgagcgtcaccccagcaacgggatttcaccctggctgcagttgttggttctgtttctagtgtttttcacacgcccagacaccaccctcaccagtccctcctgagcccccgctctgaggtccgggtccccactccaagccttctgggaccatcaccccggtctttgtctccagccctagctgttcctgagatgacgcctctgtggtatgaggcctcctttgctttttcggccaagcaacacctgtttaggggctgcctgtattgcttctattgaaatcactgctgtaatttctttttctcctgacttggctctgattgatacactatatcaggatttaaaaatattttttgacaatgtgtttcagaataatcagtttccttcgtaaccctatgtttcgttacatgcgtttaaaaatattattccaagaatgctccacaggcttcaccagcctgccagggggatccactataccaaaaaacagagagctgagagcagttgccagcctgattaattgccgtttcctgggctgggtttaaatgcctctaggaacacaaaacataaagggttttctttctgttcttcctccctttcttttcgaatgaagttatggaaggaaatgaactttgttattttccccctttaaaagtagtacctgctcatggaagaaaaaagaacactggaaaagaaaagtaaagaaaaaaatatctctatcttccttgtgacataaaaacacccatggctccattttgatgtatttccttagggccttaggtgttgtttatttttgcagagatataattgtcataatctttgtcataagcatttccaattctacttcatacttgtcttaaacactatttttatagctggacaggatgctgtaaagcagtaggttgacctggcccttttcttataatgtaaaactttgaccataattttattgtgataaaatatttctaagatttaccattttaaccatttttaggtgtaaagttcagtggttttaagtgcgctagtgtgtagccatcaccatcatccacttccaaaactttttcatcttcccaaactgaaattctgtacacattaaacactgactccccaaattcacagagctgaaggtggagtgggcattgctttccccagcccttggcaactcccatgcaactttctgtctccatgaatttgattaacgtaaatttttactactgagcttcgcttttccaataaaagttcaaggtacatagtttaaatgtacatactttaatgcaagcagtattgcatgacaccagcctgccttctttcgtcctttttaaaaaattagaccagaaactgttgttgaatcccatgttgccggtcctgatggttatctttctagtgagacccgaaaattcacgtggggacatgacagctttccattttcatgaattgcaaatgtggagggctcatggtagggagatggttttatttttgtgggttttgtttcgttttgttttttgagacagagactcgctctgtcacacaggctggagttcagtgacacgatctcggctcattgcaacctccgcctctccggttcaagggattcccgtgcctcagcctcctgagtagctggaattatagatgggcaacatacctggctaatttttgtatttttagtagagattgggtttcaccctgttggccaggctggtctcaaactcctggcctcaagtgatctgcccatctcagcctcccaaagtgctgggattacaggcgtgagccacagtgcccggcccaggagatggttttaaaacagagatgtgccctggttgccttctctgaaagtttctctccacacagatctcctgacctttggtgtggctgatttcacgtggagtctgttggattcgcaccatctggctcctgttttctggggaaactctgcgctggctttcgtcttcctccttttgtgattacataaacaaaagggtaaattgttttcttaaacgttagttttaaattgtgctaaaatacacataacaaagtttgccatcttaactatttttaagtgtacatttcagtgacatcaagtatactcaccctcttgtgcagccagcaccaccagccatccccagaacttcttcatcttgcagaactgaaactctgcccccattaaacgctgactccccattctcttctccatccagccctggcacccatcattctactttgtcttgatgaatagtatgaggtacctcatctagttggaatcatacagcatttgtccttttgtgactagctgatttcacttagcatgatgtcctcaaggttttctcacattttagcagatgacagcatttccttcctttttaattctgagttaaattccactatgtatctatactacattgtgtttctccattcagccatcagtggacacttgggttgcttctacctacaaaagaccaaattattttgtccatttaatataagttatttgaaggccaggcacagtagctcatatctataaccctagcactttgagaggtcaaggcaggaggatcgcttaaggccaggggtttgagaccagcctaggcaacatagcaagaatccaatctctacccaaaaaactaaaaactacataattaataaaatgtgaattatttgaagtttcagtgcagatcccttcttatcactgtattatctgatattatcgagccaccatgaaacctctagcacagcctacctgtggtaccgggaggccaccctcccagccacatcggggtctgcctgatttctgctttcctcactgcctgggtccctctgccttcccccagagacgaagatgctgcaagttagacttggagctctaatattgtattctaaatgtagggcatatattttaaataatcgtagagtgttagagctaaaaaggtttaatatgctttatattaaaaacatatttatcttgttaatactctgagtccattgcgtcacctcgggcggaccatttcccctttttctaaaacctacaccatgggagggtctctttgccaaaaaggagaagttcatgagcttccattgcctaatatcattctttggaggcacagtcatagctccttatctggctctcgaagttcaagtccagctgtctagatcataactttcaactaggaaatcaccgggtgccttaaaaaaataaccagcgcaaagttcaggcctcttgttctagaaaagtagtaaggttactcctactagagccacgggatgtagaattccagttactgttggggttgtgtgtgttttaacaggcacacctctttccctgcagcagggggtacacagcaggctgtgcagagtagggcaaggtagaagccctggggtatgcaggaaggtgggtggggaggggctggtgtgtcagggacaaatgtcagctcccacatcccttggtaaagtgtgactgggtacatcagatttagattaaattatcctgaaactatttttttttctttttttgagacagagtctcactctgtcacccaggctggaatgcagtggagtgaggtcagctcactgcaacttctgcttcccaggttcaagcaattctcctgcctcagcctcctgagtagctgggattataggcacctgccaccaagcccagctaatttttggatttttttagtagagacaaggtttcaccatgctggccaggctggtctcaaactcctgacctcaagtgatctgcctgccgtagcctccaaaagtgctgggattacaggtgtgagccacagcaccccgcccctcaaactattttgtagcttgcattatatagatcaaacaccttcattgcacttacatctctagtattgtatttacttaaataatgattatcaatagcaactcatttaatccttataaaccctgggaactgggtaccattatccctcccattttacagatgaggaaactgaaacacaaagagaggatatgtaacttgcccagcgctgaagactcccaccaggcacagcgcgcctagaatctgtgctccctgtcaccacagtagacaattgtactccagcatcaacaatgaaaatcacttttcactgacttaagtattattccttctccaagttgatcttccactggtctaacttagattctagcctttaggcaagagtatcttgttatgagacgtgtaatttgtttcctttcaggtgccttgcaacacaactctgtttatctcataagcagttttaaatgctatttaaattctgacaaggctgagtcctgtactgtgtgattacagagcaagcactaactcacaaagctactgtgtcctgattatttctctaattgtagagtaatttaaggaagaaggaatatatcagcaataaccgtaaaatgatgatgataatggcagttctgatgttcatacccaacaaagaaatcagcaatataactactgaaagggtgtagataaaatttgtaaatacttgcggattatgtgtatgtctaatccaaaaagtcagtctcaaactgagagttcagtaagatagtttgtaataacagaaacaaaaaaccaaagcattcctatatcctaccgtaatgatttttttttgagacggtgtatcgctcttgttgcccaggctagagtgcaatggcatgatctcggctcactgcaacctctgccaactgagttcaagtgattctcctgcctcagcctcccgagtagctgggattgcaggtatgcaccaccacgcccagctaattttgtatttttagtagagacagggtttcaccatgttggtcaggctggtctcaaactcctgacctcgggtgatccacccgcctcggcctcccaaagtgctgggattacaggcatgagccaccgcgcccagcctgattttttaaataatggaaaaaatgataaaatcccactcaatgttgcatgtaggaataaagaaaaatgcagggcctatatgaagaccataataatttactgaaggacatagtcagttgaaaaatgcagagagcaataccttgtctctgaacaagaaaactccacattaaaaagacacggatccatccccaaataaatgataaatacagttggccctttgtgtctgtgggttccacattcatggattcaacccatctcaaatcaaaaatatttgggaaaaaaaaaggctgggtgcagtggctggccaggcacagtggctcaggcctgcaatcccagcacttgggaaggccaagatgggagggtcgcttgaggccaggagttcaagaccagcctggtcaacacagtgaggccccattgcaataaataaataagaaaatatttggaaaaaaaatggatggttgcctctgtactgaacatgtacagacgtttttcttgtcattattctctaaacaatacagtctaacaactatttacatagcatttacattgtattaggtatgaacaggaacctagagatgattcaagtacacaggaggatatgcacaggttatgtgcaaatactccaccatttatgctcagagacttgagcatctccaattttggtatcccagtggttggaaggggtcctagaaccaatgccccttgaataccgagggacaactgcataatgcatttcaaataaaatctcagtttagaggggaaggttggttgaaagcttaacaaatagactctaggccagcgtggtgacacatgcctgtaatcccagcgctttgggagattgaggtgggcccatcacttgagcccaggagttggagaccaacctgggcaacatggtgaaaccccatctctataaaaatacaaaaattagccaggcaaggtggcacaggcctgtggtcccagctactccagaggctgagatgggaggatcacttgagcccaagaggtggaggctgtagtgagccatgatcacgccactgcactccaggctgggtagcacagtgagaccctgtgtcaaaaacaacaacaacaatgacaaaaagaaaaaaaacaaatagactcctgagttaatctggaagaataaatggagaggctggccaagaaatttttgaaaaaacataacaggggtagttttcaacttttttgtagcccacagcttctttattcaaacacaatctcacctccctgttcaaatactttcagtgggtcctttactgcttcctgaataaagtccaagttccttaacctgcgtactgtaaaaagagcattctgacaatatccaagggtgttcaaaaagcaatgtttacaactcccacagttctaccacttcggcagagcagccctgtgtttattctgcatgtccttctggtctttgcatgcctatgtcttttacacagtcctattcttttttttcttttttgagatggagtctcgttctgtgacccaggctggagtacagtggtgtgatcttggctcactgcaacctccgcctcctgggttcaagcgattctcccacctctgcctcctgagtagctggcattacaggcccatgctaccatgcctgtctaatttttgcatttttagtagagacggggtttcaccacattggccaggctgatcttgaactagtgaccgcaggtgatctgcctgcctcagcctcccaaagtactgggattacaggtgtgagccaccgtgcccggccgcagtcctattctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtcctattcttaattgtgttcatctgaggactaagaactccacaagcttggctttgggaatagcagtaaagcaacaacacagtgctgggctcgaagacggacagctgcctgaaagacggcagaagctccctgagtgtgccaaaagcactgatgaagttttaaacctagtccaagctaactgagtgatgctagaccttcccgcaacttctctaacctggatgtaaattgtaattctagagccccttgttttgcgggaaaaaaataatctgtgtatggtcaaatagcagatggaatgagctgccagacggaatcttttgccagtgcaacggaacaaagtacttgttcatgccaggctcaggtcccctgttacttgcagtcctccgggcagtcctgtctgctggctgtctctctccctgctttacgtaggaagctggaagaggtcaggggatttccttgaaattacaggctagtgaatggcagaacaggagctcgagcctgattatctgctaaacctctgctttggagctttgaggccttctgcacaggtcacttgcattctctgtgtaggggtgcagggttgttttctctcccatcggcttactcttggattgggccttcccagaggtgccgagaagcaaaacccagttctttgatcttctcacttcagctgttctttcttccagccaacttccaggattacatcccttggtgtgaccacaccacatctgaaatctcaactccccacttcccacccagtgacctgcacctcctgtctttcaatgctcctggcgctgactttcttgccgtccctgacaagcagccctgccttcaagttctcactggatgaaagaagaaggcaacagatgttagatgccgtgtgcacatattcccatcttgaccattctttctgtgcatgctttgctgtggaactgttggggccccatccagctgtataagctgagacatgaatgtgcttccacagtgtgggcacctcggatgcaggtacaggcccctctagatccagggccacttggcaatgtctgagatatttttggttgtaacagctggggtggagagcgctgccagcatctggtgggtggagccaggaacgcggctagccatcctgcaatgcacaggacagccgcccacgacaaggaactgtgcaaccccaaacgtcaggggaccctgctctttatcaatcctagggtttcccaaaaagcccgacagcacatttgatacagatgccaccaacggggtggagacaaggggcgagggcttcagtggaatctcagcaactaaaatcaagccgacggtcaggtcagagaagcatttggaaagcctccagtgcgtttaggggaccacgccctctcatcatgccaaggcagctgcccagtgaggtacagggtataaaggtgacgtggtcaggagtggctatttgatctccagttattccagaatttccactctcgtgccaagcatgtctctccaaatggctgctctctggcgttcctcacactccccctgaagttcatctaagatcttcattcttcaaaggtgaggcttgtatgttctatgtccaagtcttctctaaagatatccaatttgtacacatggagaacattttttgtactcgaatagttgatgactttgctttgagctatctctcaagggccaaagtgcaaaagggcaaacccttctattagagtgtgggtctatgtttttagtgttatgccgaagtgtgttttagcctttattttcctttatggaaattcattttcttggaaagatcattttggggatgctgttttaggatttctgtaccttcagctggaaggatgctcaccgttcctgatgttcatgtctgcccttcagtcagggagcctggaagccaagttgcttagtggcagtgctttacttttaagccttcgaatacatcttgagtaccttaaacttctctgtatgctatgggtactgtttaaattcagattatggagtcctattctccccacacttcttttttttgtgaatgacatttatcaatgacatttgtagcgtggtggattctgaagttttcagctagtagcgtaaagatttatttcatggctctgactgtcaggaatattctcttttctagaatgttaaactcataggcaggattactgaggcaaagccacataaatgagggaatctctggaaaaaatacattgcttttattttgtactaaaattgccattttttttttttttttggccaagtatagtggctcacacctgtaatcccagcactttgggaggccgaggcgggtagatctctcgaggccaggaattcaagaccagcctggccaacatggtgaaaccccatctctattaaaaatacaaaaaaaaagtagttgggtgtggtggcacacacctgtagtcccagctacttgggaggctgaagcaggagaatcacttgaacccaggaggcggaggctgcagtgagccgagatcacaccactgcacaccagcctaggctacagagcaagactatctcaaaaaaaacaaattgccattttctattcctaagtatatattgaagcatttgatttatttcttctcagtggggtatactgttagctggtgaatgcagttgttgaggatgaagcttatttccccatgtcagcatctattctgaacattttaaatgaactattctgagagcatgtatagattttttttttcttcacaggagagctgccttaggaggacttttcagagtttgtgcctgtaagactgagaaatacataatggattttagctgtcgtgtttttagaaggtaattggtagatatttgcagtgcattgtcttcatgaaaaacaaaattgggcctggtgcggtggctcagacctgtaattccaacactttgggaggccaaggttagtggattgcttgagcccaggagttcaagatcaccctgggcaacatgctgaaaccctgtctctgaaaaaaaaaaaaaaattagccaggcgtggtggtgcacacctgcaggcctagctacttgggaggctgagttgggaggatagcttgagacaaggttgcagtgagccaaggttgtatgtagtgagccaagattgtgccattgcactccaacctgacactcaacagtgtgagaccttgtctccctaccctcccccccccacacaaaaaaaccccaaaaatcagaagtggttttcttagagatgctttactggaggtgtttgtggccatttccttggctactgtgtatagaggaggttactgtggtcactctggtatggacttaaaaagcatcaattctgtggaacacactgggaaagcggatacatttaggattgctatagacttattcctagacactttttgagatgagtttaattccagagtaaaatacattagaaattattttaagtatgcctcagagtgtatcacaaaacaacatttaatggtgtaatgtaacgccatggaagggctctgagctcaggtacagtgcaccttgactgggacacatacagctctgaggcaggtccttcaatattgggtcctcctgctccttatcctccctcaactctgccatccactcttcctgcacaggaagctctgcatctagttatctgccctctcctggccactttggtgtcctcattcccatggagctcacaatcggatcaaatcctgagtcagtacaagatgccagtgcctgcagctcccctccccgctccccacacccagcctttggtcggcagcccctcaggccttgccccacccactccatcttttctcactgtcctttcagcctccagacaggctcacatctcttccatccttaaaaaccgacaaaccatgaataaatctcccccatgcaaagccttttccttggtcccgccttccttcaaggctgccgtctaccatttattacacatgcacaaatcacagaaaatgtttaattgccaaattttaatggcagaatgtaatgaccagtgtttttctagttgcaaattaaagtctttcctgaccttgctctcttcactctgtggcttccaggagatgtctctattttctgactctctaactaccccttctctgtcttgacttgttcttacacacctcttatccttcccatgtaagtgtctcaaggttccttccttcaggctcctttctgttctgtgcatgctgcctgattttatcatcacctttaactaatcggtagtgtgtgctgaggtgcctgttagactcctccactgaggctttctgcctccaattcaaattcagttcaatcaataatcaaacccatcaccttccttagaaaatctaaagagatttaaaaagcaaaaacaataaaagacctattagatgaaaaataagtgtgatgaattgctgggtgctaggtagttatgaaaaaatatcctaaagacatgtcatttttaaaagagtttctattcccaattgctacagaagtataaaatactgaagatcaatgagaattaatgacaattcatcaaagtcctccattttgttaggaaaaccattcatccatctatccatctacccacccatcatttataaggcacctaccatgttccaagcagtgagaacatgcttttaatcgggagagcccattcataacctgggggtgggggctgagggaggtggtgggagaggttcagtacccaggtcacagggcagctgtgggaaggctgcatgctgccatatgtaagcccggcactggagctgttgtggatgctggagacaagctcactgttgctttccagacgctcttgctcttctgtccaccggaggcagtcaggaccctggcctgagggccaagaatactttgtgcctgagctggaccagctggccgtggggtaccaccttctttgcagacagcaggcagggtctggatcccctgcttgatgctcctaccagtgcccctagtcttactgggagatccggctcctggcattgacctgggtgtgtgccctgctttgccagtgcccctggagtgggaggtgtggtcactggtccaccaggaagacagctaagggcattcgttgagtccacgtgatgactttctgctctgagtgaggcccctggatggctgggaggaaggaagcagctctgcgtcaggcggcgtgccgctggtgcattccatcatgatgtgctaagggctgaggagacctgggttgaaaacctagcttcgctcttccaatgtgcatctgtggacaagtgctataacctctgtgagcctcagtgtgtggataaagtctgttgtaaactgaaaggtgctgtgtaaatttcaagtgatcatttcatgagccacacgtataacagatgtgtttttagatattagtcaaagggatccaaataggccaggtgtggtggcttacacctgtaatcccagcactttgggagggtgaggcgggtggttcacttgaggtcaggagttcgagaccagcctggccaacatggtgaaaccccatctctactaaaaatacaaaactagctgggcgtggtggcgcacacctgtaatcccagctactcaggaggctaaggcaggagaattgcttgagcctgggaggcggaggctgcagtaagccaagatcatgccactgcactccagcatgggtaacagagcgagactccatctcaaaaaaaaaaaaaaaaaaaaagaggtgatccaaataaagcaataacatgaatgtaagctcatggtttgtagaagtaatttactgacatttattctgctgtcatgagtatggctagtgattcacgttcatgaaaaacagatgttagggctctgatttagaaaaatgacttcatgttagttatctgactaatggggaggctgagagccactgtgtcctccccgtctgccctcagccttgtgttgtcatccctgtaagggtttgtctctgtagccccaaaccacagtgggaggcgcagctagtgaaccttgcaacagactaacaccatggagacaaagtaaaccatgtttgggtgtggccccaaattggctaactgttctggcattttctggttagctatgattctgatgttcctagaacaaaattagaccatgctactggcctttcgttcttttctcaggagtctcctatacttctgagaatggatttttagatttcagacatgtaattttcattgagagggcacagaggaagacaaagttatatcacaggcctggcaacttttaaggatgccctctgaggcagtcagacaaaacccaaagtaccctctcagtgcagagattctgggcttaaccagtgatgtcgggaggtcagttctgtgtgtctacaggccattaactgcagtttggaaggggccataaattccaaggcacttgttagaaggggctgtccctggatcatccttaccaaaagaaggaggaagtcaagccctggtcactgacctctcagctctttagttaagaccctgggccccatgctggtatggtccagatggacccccttttttttttttttctttttttttttttttttgagacagagtctcactctgttgtccaggctagtagaatgcagtggcatgatctcagcttactgcaacctccacctcctgtgttcaagtgattctcatgcctctgcctcccaaatagctgagattacagatgtgcaccaccacacccagctaacttttgtatttttagtagagatggggttttgtcatgttggccaggctggtctcgaactcctgggctcaggtgatccaccctcctcggcctccccaagtgctgggattacaggtgtgggtcactgtgcctggccccagatgcaccctcttccgaggaaaccccccacccccctgctcagacctttccaaggtgccctcggggttttagttttgtcttcgaggtgtatgatttaacgttactctgccaagccatctttagagctgtgagtactgggatgaacattttgtgtatctccatgtttctataaaatgccacctttcagagccacacccacaccctgacttctgacccggccttcccatgcgtcaagtttgtgggttccagtcacccattcaccaccctcacaattgaccttgctctacgttgaaaaaaaaaaaaaagactgggggtgggagaggggactacctcagaagggggcttcaagaaggggactttaaagttacctgtattatttaggttggcgtaaaagtattgcatttttcgctgttaattttaatggaaaaactgcaattacttttgcaccatcctaataaaactgggaggcaactgtggatcctctgcattttattcctggggctctgggatctaaaaacaccaagaaagatgtattagcattcaacttacagtatagactttgctcttgagctggggatggttctgagacttccacctcacaggactggctgggctgaaacccaagtcagaatgtagcatcctctcatctagaagggtgtcaggatggcagttttctttaatatgctactacttagcagaatcagaaaccagccattattttattgctggtaatgttcatttgttcctgggactaagactcatcagctcgctgcttcttactctgtgagtgtcctggcatggtcccctccctgccacctacatcctctgcagcagccccttcccacagctgttgtggcaggcagtgggtttgttctctttcctgggctgcccacagtcttgctgcctggcccatcccagttcttggtctggtgcccagcttccttcctgctatggaggaggaggaggaggcctgggcaccttgagtcagggcacctaccaaggggactctatctggaaaagaggggactccagaggcagcaaggcaggtgctggtttgcttttactggactcccaggacactaggcagcaggctagcagggcagctcaccctgactgtgcccagcgggatccccgtgttagagcctttggtcctcaccctcacagcgggcactgtcattatcaccggcatgttttgggtaagactccaggcacagaagctaagtaacttgctcaatatcccttagtgagtggcagggccaggaactgaacgaggtggcttaattccagagcccacttcttaatcccttccctgtatggttttcagaagctggtaactagcaattgactggcagcctgggggttaggaaaatgtgtcttgtggcaattacaggtgtcttcaagcattgcctcagggacatgccaagggaacggaaaccagtcccagtaccctgctctgggagatgtggtcacagggttcggggtgttgagtagctttagaatctgcctatctagatcagaatattcaaaatcaagtctcagaagaagagggctgttttattaatgggttatcattctcatcagtgaagttgtgaccactggtaaaagtctaactgctttctacaataaattcccagagaacatttaaaattattttctccaaataattgcactttaaacaatcaagaattgtgataggccaggcgcggtggctcacacctgtaatcccagcactttcggaggccaaggcaggcagatcatttgaggtcaggagttcgaaaccaggctggctaacatggtgaaaccccgactctactaaaaatacaaaaatgagccgggcatggtggcaggtgcctgtaatcccacctactcgggaggctgaggcaggagaatcgctggaacccgggaggcagaggtcgcggtgagccgagatcgcgccattgcactccagcctgggcgacagagcgagactccatctcaaaaaaaaaaaaaagaaagaaagaaagaattgttataacaacatttaaataagcgttacagggagaaaacaagctattgaaaggtaggcatttcattatctttgaaagttgcttttgtgagcctgagatgctgtcaatcaaagacagcttggcctctgttcatcttaagttcaacgtttcttccccagcggttctctaggcctttgctcggcccctcttttccttctcccctatccctcccaagtcgtccttcggctcctcagcacccattttccctgctgcacaccctcctgacaactcctgccctgaagccctgggcccgggtcacggcgggaaggtgagtgctcacaggcgcgagctcacgttaccaagttgggtcagcgtgcagagaaaagggaattgggaattggagggctgtaaaatgtaaatgtgctttaaattttacatttcctggcgtggccaggacaggctgaccttccgattacaatccgcgtcatcccgtcgcttctgcccccagcctggcgaggtcgggaaccgtttcccgcaggactttcattgggagttacgagggcgccctgtgcctggaggtggcgcgggctggagccctcccggaggagaccggcgcctggcagggggtcgtcgcggccgcagcctggacggtgtggaccccgggttctgcgacgccagatcggccccagcggcccgcacccgcaccctgcaagctcgttctcccctgcgggccgccgcaccgggccaaggggggctgtgtgcacgcagctgcgtcgtcctggaagtcggcccttctcgggatgccgcgttagtggggtgcccggccggcaggtgcagcggtgctggggcctaggcttccgcgtccaggaagctcagcgtggcctgagggtgatggatgtgggggagccgggaactcataccctcgcccagccccgggcaggtccccccccggaggggaccccctcttcgggtcgacccctactgggcgcggcatcctccccggagcgcccgcttcccacggcccctgcgggtggagctgcggccggagcctgaggggtcttttcctccaggtcctctttccggcgggggccggaggggtggtgatggacagcccgggaggggcggggcaggaccaggaagatccttccgagacggagcgcggggggcggggcggggctcgcgttaagggagcgcggaagggcgggacaggccgtggggcggggcctgggtggggcggagccggtgggggtggggaaaggggcgtaaccgggagggaccctccgaggcggagcggcgcaggggggcggggaaggcgggtcatggggcgggggcggtggggcgagtcatggggcggggacggggcggggcgtagccgggagggcccctccgaggcggaactgcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggtaagaggaaagcgcttccgaaactttctttcgtgactgcggcggggtttcaggggcttccagctcgttccgaggtcaatggcaggcgcaggtgcccgggaggcgtggggtgggctctggcgggaccccagcgcggtgggagcgggcgcagtgggcgcgggtccgtgagtggcccggcgagcggcgtccctcatgcgctaggaagcacgctttattgtgggacgccacctccaaggacgaaaaggcacatggtctctccccgcccgaggtgatgggctgcagacaggctctgaccaggtctgcgcctggcctggagtcacagggagctgctagtttgctattttacaaaatacagcatcaaggaccgggtggccagagccggtgccctcacccgctgttggaaccaccggggagcggctggggtgctttggagcactcaacccgctcagcacctggggaccacctccgccgaggactccagacgccaaatccactttggctagtctcccgggtccgcccagcgcggacaggatcctgcctctaggattttgccgttgtccagctcaatatgcagtcgtggggctacggctgtagtttggcattaaaattgggcaggggatgaggcggagagggtttgcaaatacacattttcatgcagcttgtggttgaacatgaatgggaataaaagtgaaagggtgcactttggaaaagaaatataaaaccctagctttccacttaatcaggtgttcgtgggatcttggtaaaagtatgagccccaaacaatcactctttcatcaggtagaaattaatcatctactgggtgtgtgtgtaagatttaagatgaatcagactgccttgaccttgggagagcttattaggaaatgccagagagaggtgtagaagtagagtctgatgaactcatactgaaaagccagttctttgcttgtcagatggttgctgttttttaaatgtccattttagtgtggtttttctgtgacttcgtttaaaactctggcagtgggccagccctctggagccggtttttaccccttcaactaattagttcctaggggcctgggaagagagacccttgaatcaccatcagggaagggttcttgaaagaaggaagggtgggaatgtggttgagcggtgccagtgttctgaggagcagcctgggacaccatagatggcaggaggaggatggaggtgaagagctgcctgctggacttagagtccttggagaagggaagagtaaacattgagaacaggatgtgaggaaactagggacaggctaatcagaggagtaggtagaggcacacctggagcagctaaggcactggctacagggtctattacttaaggctgggagcctcctgggcgggtctgggttcagatgacttcgagatgctgccgggaggaagggagaggaaagtctggactgtgtccaactgagtagttatgtgatcagcccaggcccactgtccctcacccccagttccagaacccaataagctttgaagaccggaaggtttgtgttttgttttgtttttataagtttgtggcagaattttggcagtgagacttgccctgtccaatggggggctagttttggtcttcactgatccctctgagtgtgaattttcttacgtttctctgcagtcttgttgatgtctttgattaagggctgctactctgggttgtaccagaatatatggtgtatgcatcttactacgtttctaatgtccaaaaatgctgaattctgaatcatggccccaagggttttcagagagaagttgtgaacctgtaggagcttttcttggtaaatggtagcaaaaactgtatcagagtgagacatggtgaacaaaagcaaaatgcagttcctgttaagaggctaatgttcaggtagggaaggaaatgtgctgagtggtgatgggaattgggggtcatcatgggtggggggtagggcgtcacccagcggctgccctgggccatgggctgggtataggcacaggaaagtggttgtgggtgtttcacactggtttgtgccagttcttgctctgcattgtgtccgtgggttcagggatgggtctcctgcggaaaggagggactgggggccgcacccatgcagaggagagccgggttggtcagaggaagtagatttggcaagctccacctcaactagaagacaaaagcaggatctgagtgggagcctgggcttcttcagcaagtgggcaccagccctggagctgtaggagagggtccgatgcggacagtggagacactgtgcatttctgcagcttttgtaacttccctgtgtttgcgatggcttgtgtcaccccgctctctttccacatactgattagcattcagcccttctaaatgaccagcactgtcccaagaaagggctgttaggggagagcgtggacacacagtctcccaagtcccatctcattataggtacctgggccagggtccccaggtgtgggagagtggagtcttgaccaatatggggatgaatcagttggcacgaggcgggctggccctgctctagctcagtctgagatggtggagcgtggaatcatatggtgtgtgttttaggcatgtcatttccccgggcaggtaagacataaatatagtaaggtaggtcttttctagtagtattgagagtgtcctactggggcaaagatggagactaaatttccctttttctttaagagtcagtttctgttcagcctgagttaatatcccacagcggaagcctccttagcaaatttcaaaaaaccctgcagtctcaactgccacttatgctgagcacaggaaatcaagttatttatagttgcagaacggtgtttcagcgaagttgattggagagttacctgattatagtgagattcttatccaatccctacagaattgtgagactaaatgttggtgcagcatgtttggtcctcaaaaggcaatgtccaagaggaacttcttatccccgaaaaatcaggctgtgtgactcagcaaaggaattgtttatgactggttactcatatgccagtgcttccagaatatctgctcgtatttaaaggagtgatcttgaagccccagaggccataatgtttagattaccaacctcttcaccaatcagtaagtccattacatctcactacgtgttagacatgggacaggagaagaggatttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctagggaaaggagtgggctttccctgtgggttgagaacctctgtccccctcctctgaagtttccccagtttttcctgcttctctgctaggtgggtgccttagcatgcttgtcttctcatcgtgcttctaaacttctctgaaccggatttatactcttaggtcagtagctgtcaaagaagacactaagtagtgaaagtagctaatatttaccaaacccctgctgcgcccacctggtgttttatgtgaaggtcttctctaacccttgctgtaacctcatggggagcagatcgttttctctcagtttttcagataaagaggaaactgaggctcagaaaggtcagggactttccaagccctcacagctagtcagcagtggagccagttcagacccaggcctgctgactcggaactggtactgataactgtcaccactgtatgcaatgctgcaggcaggggctggcaggtagtaaatgtgcaagatatagctgtggctgccacggctgctgctgctgcttttgtcgctgttgtcagcttttcttggcagccctgctgtctcataccccagtattggggctgaaggatttctttttaccaaagctgcctcttaggacagaagtccttgtcttgaatgcatactgggaagtcttcactctgtcaaacttttctgttctctgcctggtaatttccagacagaagagaacattcaaagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactcctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtagtcatggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaataaagtaacatcaatcattttgttcccgattaatacgtttgctattttaggatgcgaaggactttaaagaagcttattattctgaaaagcaaagcctggagatttccagtagcaaaacagacacagtctgtggacaatctcagtgtacaaataattcacctctggcatgaacccaaagaatttcagaggggaaggaagctcttaaagattacgtcccctcctacttctttaatgagggctggggttcaaaaaccgagtaacttatccaggctcacataactgtaggtgacagagcccaagctggaggctgtggctgggtcttcagactcctttcttgacagtctgcacctgcataaactcagacctttactgagaacagtgcagccatagctgagagaagcagtcggcacccagcatttcttggacttgtctgccaggtcccccgagtgcagaggacagtgtgctggctcctggggcctgtgggcccggccaggagcagccttgtaagctaaagccttctttgaaggtggccgtcttaccgtaaactttcatggtaatttcagtctactccataatttgtctgagttaattttgatggaaacatagtgttttaagtaatcagttaggctttgatctctaactttatgccatccaaatcttcatgatggcctgagcaccaggcacccagacctgtgctctgaattgtgccggggctggttcatacagtgtgatggagagacgagagatccacactggagttctgaagctgtggttctcaaccctgtctttttacaagttccttaacttccttactagcctgaaatgaaatgcataggtgagaaagtcaaccagcgcacataatttcgagtcaatataacatttccttaaaaaataaaatacaggtagtttatagtaacataataagaattttgatatagaaatactcaagaccaagtacaccagcagttgaatgcagtgatgagacctgcacacacctgtgcctggcgtcacagggaggctgacacaggtgtgttgcactgagacccacacaccacccctcatgttgctgtctatgacgtgacattctacaaagttgactaactctcaggaaagttctgaacaaagccaagtatcatcatcttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcgctctgtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcggaggtgctagccttgtgccgtccgttcttgtccacgtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcccctgcttgtctgtgaacaaactggcctttgtggccacttcaggcttcggctgcatcatattcctgtcacattcacgtgagtgaacttgaattacatccttaacacttttccaaaaaggttataaactagactggtgatgtatcatggggcctagaaaaataatgctgctgctttttcacttctctgcttgacgctaaaacctggaggcgaaaatgaatgtgtgtaattaataggagaacttcctcctgtttgcagagtgctttacagctggcaaacggcttctctccctgaacagccccgtggggcgtcatttccatctgacatctgaggagagctgctgttcatggtccagtcctctgtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacatgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagagtttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggcttttgaagcaagctgcccagcgagcctcccgcagcacctgctgtccctttgccagcagtcagggcccctgccccaccagtgttggttgtgtttctgttctttgaggagaccacatgatgatcttctggtaggagccacaagaaggatacaaatgccattagagctgctagagccccagacgtcactggaattggggttcagggtgttgggctgtccccacccttaggcagtactcccactgcctacaacacctccagcgcaggctgaggccatgcgaggatggaagcacatgtgggctaggccaggagggcgtgcgggagggctctccactctgcgctccgctggggtttctccttgtgtcctggtcaataacttcttctctctctggttctccttggcctgagcccccagcctgagccgggctgtccctgagttccctgacccggaagaagggacggccattatctttgggtgactgtcttcttatagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctgtggctcgggatggggatggtgacttcttcacgcagtcttctgcaggcctctccagcctggctcccgagatgtcacgcatgggtccatgcagcccagaaaagaccctgcagggggagaagggtcactttggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtcatattcacatatggtaaaataagacgcaacaatagaactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccattgtgggcattcctgagaagccagggagcctggatcttgtcagaggagctcctccctctgctccatcctaaccccgcgggcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactccacatactgggcaaggaggtggcagggggaggggcttgtgggaacccagatctgggatgggactcagccaacagtttaaagagccctgtgcccccactacccagcctcaacaattgttagcttatagccgtttacaccccacccaggttatttgaagacaagtcagagggagataatttcactgtactcctaaatgttttagtatctcagcaaagattgtatgggcagagaaaggaggcttcagggtgtaggaccccaggagcaggcaagggcttgctctttccctgttggctcctgtagggtggggacagaccagcccccatgaaccctagcgagggccatgccaagaagccgctgttctaatctaatcagtggaggatccagcaagctcggatgggagggaaagaatgactcaacctgcaggccgtctggggtatgcacagtctcgtctcctgagttctctgaagccctttgcagtttttgctttgtatcctaaactccacaggcccgaaccctggcactgagcttgatccgctgcagcccagcccgttcctgtccccatgctggaagcagcctgtcaactcacttccttggtttcctgttgctcttcccaccccatacctgctccccacatttctatcagagccctgtttctaaaacaaaagtcagattccgctgtgttcttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctctggggaagaattttgtcgaaactctgcagatgttcttttttttttttttttttcaaggcagagtctcgctctgttgcccaggctggagtgcagtggtgcaatcttggctcaccgcaacctccacctcccaggttcacgtaattcttctgcctcagcctcccgagtagctgggattacaggtgcccaccaccacgcccagctaattttttgtatttttagtagagacagggtttcaccatgttggccaggctggtctcaatctcccgacctcaggtgatccgcccacctcagtcccccaaagtgctgggattacaggtgtgaaccaccgcgcctggccaactctacggattttctctcaggcatcttaagcaagtggcaagagttattctgtggctaagtgtgtagttttgtgttcgtgaagatggtcatgcataggttttgtgccagtttaaatgctggctcatatatttgttggtgttgagttaggcagattccaagaattgcctgtaagctaagttgccacttccggtattgccagcactttgttttccacatatgagtcatgtgaggatcgtaaggggggtagatgttctagaaggcaggggctgcaaggatttggaattgtattcagtgacaaatggacttctttctgaattctaatgtaaggtggagatcgccatagttgacctgtcttggaggtgggcttgcgtgtgtccccatgaggaattgatgccctaacatgattcatccatggggttcctttatcagcccaagcccatgtgcctcccagcaaaggtcattgttttttagtctttaaatgtcattatccccaagtgagggacagggtaaacctgttaggctgaaggtgggccatgatgggaaccttttcctgggtggagggcagacccccgagagcagcggggtctgacagggcattgttttggaggcctgcaagtctggagcaggtgcaatactgcacgctcaggcaggcgagctctgcaaggacctttggccagacccgagcagagctaagctggaatagggtggggtactgagcaggcaggcggggaagtgggtgggcgtgcaggtgcctgggacccccctcagctcacagagatactcgccctgtgagagcaggagtcacctcagacctcctctccttctgttatctgctagtgtgtaataaatatccacaattcagcggcttagaataacacacagttatgatctcacagtttctgtggtcaggagtctgggcacattggccaagcgcagtggctcatgctggtaatcccagcactttgggaggctgaggcaggtgagtggcatgaacccaggagttcgagaccagcctgggcaacacggcaaaaccctgtctgtacaaaaaaatacaaaaattagctgggtgtggtggcacctgccctgtagtgccagctacttgggaggccgaggtgggagaatcacttgaacctgggaggcagaggttacaatgagctgtgatcacgccactgcactccagcctgggcgacagagggagaccctgtctccaaaaaaaaaaaaagagcctggactcagcctctctgggtcctgtgctcaggtctcacaaggctgcaaccaaggtgtcggccagtctggggtctttctggagttcaggcccctcttctgagccacgtgtttgttggaagaattcagttccttgtggttgtaggactgtggtcactgttcctgctggcgtcagtcagccaggggctgctctcagctcatcgaggccccctcccactgggcagcttgctttctcaaagccagcaaggacactgacttctagaccctcttttaaagggcttgcctgattagggcaggcccataggataatctgtcttttgagcaaggcagtcaactgacgaaggattttaattatttttttaatactttttgccatgtaatacagcctaattacagtggtgtcatccattatgtccatggtcccacgcactcagtgggagaggggtatgcagggcaggtacactagtggtgggagtcttggggaccaacccagaattccacgttcccacacagtgggagaggggtatgcagggcgtgtacaccagagtcttggggaccaacccagaatttggccgactgcagttgtctctccctctgttcccttctggtggcccttctttcccccaaccctttcctctttcttacatctcacccctctgctcctcttcttcttcttgcatggcctcccttctcttttcccggcccctcctctctgttcctctgccccccaacccccaagctggtgggctatggctgctatgaaacctcgtacctgctctgtactggcttagaaactgagccaatggcacagagccacctgccttaccaggaagggctgcacttggcgtggccttggtcactttgctggcccattggtagggccgtaggacgtcactctaatgcctttccttctctgtctcctccctctttgcttttgtgtagacccaagagtcctttcttttgtttgagacagggtctcactctgtcacccaggctggagtgcagtggcacaatcacagctcactacagcctcaacttcccaggctccagtgatcctcccacctcagcctcccaagtagctgggaccacaggtgtgtgctaccacacctggctagtttttgtattgttggtagacacagggttttaccatgttacccaggctggtctcgaactcttgacctcaagagatcctacctgccaccgccttccaaagtgctgggattccaggcctgagccaccatgcctagcctggccccaagaggcccttcacaccatgtaatatggtcttggaaattgaaaatggcaacaaggtatcaaaatcctgatgcagttgtgatttttgacaccccttgatttgaaagacatggggtgggttgataaaggagccaagcgaatagaacaaattcctcatgaggacacaaccaggcaacctcaagacgacagatcaagtgtggccagtttgcaacttagattaaaactgagaaagaaggtacatttgtaatatagtgtaagtctaggatgggagagagggacgtccctgtcaggaccacccccatgccaggagcttgctggccacctcggaagtcccattttaatattatctaggagccggttgtggtggtgcaaacctgtagtcccagctactcaggaggctgaggcaggagggttgctagagctcaggagttcctggctgcagtgagctgtgatcacacctgtgaatacacacacacactgcacttcagcctgggcaacagaacaagacctcatccccaaaggaaaaagaaaaaaaaaaaaaaggaagaaaaaaaggaaaagattatgtaagacgtctgaaaactgtttatagaaccattgttggaaggattacagacgtattctcaaaaaacacttcagtagaaagagggtggggtttgtttgataccagaaaacctgcactcagtaacacttatgccatcgagcttacggggctgtggtatcacatgaagcagtgaatacgcatgcagtttttaaaatgacttgtaagttgtttgtagaaacagttcagatgccaggctcgatagcatcatgtccattcctgctcaagcatttgaaacgttctcacggagcagaatgtggcagaacagctacaagctgaaaaatacttatatggaggctgatttttttagtgcaaggaaggactccaacagctagaaccgttctgctatgatcttcattgtgttgggaaaaggtggactcccagcacggctgtgttttaaggggaagctgagggtgcgtgtgtgctgagaagtgactggacagcagttcgctgggattacagtcccagctccacgccagccagccctatggcctcagatgggtctggcagcctctccaggccttcactttctgctctgtaaagcgaggggttgaactggaaacctggagtagcatccagctgttaacactctgctccatgcatctgtcagagctccagaaggaggctgactgcccagccctgccacctacaggctgtgtgaccttaggcaagttacttaccctctctgtgccttcgttccctcatatttaaactggggatggtaacagtctcggcctaatgaggctgttgcaaggaatacatggcatcatatccataaagctcttagaatattcctgcctagcatgtggtaaggacttgataaatggtagcagttcttataactatttctattgctcctgaccacccttttactctatgaatctggaatttattgctgtatatctgttaaactctgaacaagattttctttccgcatcatcactgctgaccctgtactgggaaggtgcccgctgctctgtcctctaataagatgccctgtccgtttcaggcggaagcccggctcgctgcaaaacgggcggcccgcgcggaggctcgcgagatccgcatgaaggagctggagcggcagcagaaggaggtaacgcttggggctccttgttgggtcttttcacagtgatttgcgtgctgggcccagggtgcaagtgcaggcacctgttgctgcagacgcacctggctgtctcacgttgctcacggtcagagtgcgtttgcgcctgtgacttctgcccaaggtcaggccaggagtgcgcatagcacggataccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagacgggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttcttaagaagatgtgaatttattttgttagacagaagtaaccagctgccttccccagggttgattttaatacacaggttgttgtttggcttacatagccaaatttaaaaaggcgagccagtgtttaaaaccagtgagatttcggataaaaatctgaatttccagattctcttatggtggttgtagattccgccacattcccagcaaagaccaagctggccacataccctgcagggtcagggccctgccacaggtctaatgtgctcattgccctccgctgctaggagtttgccgctccatgtagaaacctgcatgcagaggctaggcagtgtcaccaagccctggaaccatcctgcacactcaagctctggtatccatagtggtgccagaggccactagaaggaatagtgcttttattctgaactggtttttaaatatgtatatgtataatttttttttttttttgagatcaagtcttgctctatcgcccaggctggagtacagtgacatgatctctactcactgcaacctccacctcccagattcaagcgattatcatgcctcagcctcccaagtagctgggattataggtgcgcaccaccatgcctggctaatttttgtatttttaatagagacggggtttcaccatgttggccagactggtctgaaactcctgatctcaagtgatcctcccgccttgacctcctggcctcccaaagtgctaggattacaggcatcagccaccacacctggcttaaatatatgtattttaaatgacaaaatctcaggtgctttttcacactgcccagtatcagtgtctctgtagaatgtgtctgttcatacagacacatttagataaaaacgtattgattgtatccttttttttttctttttttgagacagaatcttgctttgtcgcccaggctggagtgcagtggcatgatcttggctcactgcaacctccctctcctgggttcaagcgattctcctgcctcagcctcctgagtagctgggactacaggtacccgccaccatgcccggctaatttttttgtcatttttagtagagatggggtttcaccgtgttagccaggatggtctccaactcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttcaaaaagtaaaaaaataaaaagtagttgctactccagatgggaaaccaagtcttgggcatttaattttagtatcatgaaaaaggggtgcagggcagccctcactgatgcttctgatgagcacaggccttgcggagaacatctgatgaaatcgggaagtctcacgtaaaacgccatggtttgccttcttcagcatgagtacagatgtcatttgcttagtagatggcattcacattttgaaattcttctccctacagcatggttttatcataaagatatttcaggggtcacaggggtcaagatatctcgccctgttgcaaattcggcggaacatccgccactgagagcggtggttttggtctgtgctctcaccagcagggaccggaggagggggtggtgtcccttgcaggcagcacctttggccaacgtcaccttttgcacggtcctctgtggatctgcagtctcggcttcctcatcaccgatgcctgcacttcttccctcacgaccgtggcttgcggctgtgacacagggcgggcgtcgtgggcgcggctgtggactcctgcctggggttggtcacggaccaggagccagagccacccaaatttaccaggttgtggaatgagagcctgggaaggtgggggacatgtcaggaggggcagagaaatgaacgtggccaagatggtgagtgaggacaccgagtgaagcagctctaccggggggtggggaagccactccttgtggcagcagaggatggacatggcagacaggaagctgccctgggagacgagagccagacgaggaagggccagcccagtcagcccagcgcagcacgcgttcctaacggcggcaacggtgccttcatgaatttcgggtctttgcaaggcggcagcattcctgtttaaagtttatgtctgcttcttcaaaagagggatcgaaagatcttaaataagatagatgtgtatttcgtgactagtcagagaagcctggggcggggggacatcccagagctcctgccgtgtggcagagctgggcttggtgctgtcacctaccactggtgacgggcatcttcccaaactttacaggtgaggaaaacaggccttagggagatacacagttttccccaaatccaagaaaatagccaagccaagattcaaatcagatttgaccagatacaaagcctgtggtcttcctagctcacccctctgtctcaaaatcagttctgtaccaacaataaaaacaagagtggaggagggagtgaatccgtgggccatggggttgaagttcacattgaggacgctggcacgcacagcaaagggggaaacagaatgatccacataatcctagtcactttccaagtggaagcatgccttgaaaaataaagttctccttggtgtggaatttgaggcacaggaatatgaaacataaaatatacaattttcttagaattttctataaatacagaatgagtagctttcacctagctgtgcttttatgtgacccaaagggtggggcagaggccaggaggaatgtactcgtgtgtgcgcacgcattcgtgtgtgtgcgtgtgcatgtgtgtgtgcatgtgtgtgcatgtgcgctcacacacgtgagcatctgtgtatgcatccagagggaagagtgagtcgagctagtggggtctgagcttgcacgtcttcgggccatgcctggaggatttgggaaggtgcactgacgacacctccctcacgctcttctttgcatatcacatctctgggcctggctattattagaaccagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtacggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgatcatttctcttttcttgctgctgacttgataaacattttggttagagatgctttgtttcttacagtcatattgttggatgtagtcacatgtgttcccccatataagactagaaatgccaacttcttggtctcgcagttttggcagtgccttcaataatgcctgatatgacaaatgtcttaatgaatgaatgaatgaatgaatgaaaatgagtagctatctcagttttatctagtgattactacaaaattaaaagaaacctctgaagcaaacgaatatgtcaatgtatgataataacctcttttaggaatatttctgttatattctaatgatcactccatttagctggaattttcctgttattctgtgtgtgtctgtgtgaatcagaacatcaaagcctctttcttcattatttgtgaatttgaccagttaactttccaattaagtttctgtactttttgattaaacttttattaccgcaaaaagaaattctgaattaaagatgaaggaagtactttttctcattgatggcaataggttatacagacttctgtattagaataatagcagtatttttggtaagattcgtgtggctatgcccctatttccccaatgtatctaaaatgaaatgtaaagtaagtgataaaattacaaactcttgtcagtgggacctcacctgttttcttattcacattttactgtattcgttgtgacttgattcatatgtctagttacttacagaacctttcattctgatgttactgcttctttaattggattttacatttcttttttcttctgtccttctctatagatctatcaggtccaaaaggtaggctcttctttctttattttctaacttgcatgtactgttttttccttgccaagggcctggtcacctttcagaaataacaccttgcactgaagatacatagaagttcttactgtttattttactactttgtgtatgaatttgtttgaacaagaatgcctagatcctcatcttgccccactcaaagcaacagtcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatgacgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagtttctagacaacaactgtatttttctcttagagcagatgagaaaatcagaataagatcacttaatttcggaggttagagcacacaggcctcggaatgcacgggcagtaaatttaagagcctgttgtgttggattcctgtgctggccatgatgacgaatcgccttccctgctggagccctgcactctgcatagctgctgtcccgaagagtgcaaagaaatttgttaagtagatgccagaatctcttgtgcttgactagtgtttccagggcccaagtgtagaaatggatattgcagctggagttcctggtcgtcctcagagagcctcgggaagaactggacaggtgcaaggccaggcggggagccctccctgtaactgacagcaggacgctctcatccaaaacctggaagaggggctctatctggtcgtttccacttgcattcatgcctttcttgtgctaggtcacattattttctttttactaacgtgccagggatacattgtgagaactttgtcagaatgtgaatttgtgtagaatgtgaagctagaaggagccccggaaacctgcagtggaggagcagaggcacagttttgtagtaaaggtgtgcccagggaagggaaggctttcctcattgctgagatgtctggggaggagaggaggcggcgattgcgcctccggcccagccagctgctttgcggaacagtttctctggaatcaaagctatttctgaaagtagcgcggctcctgcttccctccgcatggcttccggatcatggtagtgattgacgtttgaaatgtttgcccttcctggactttgctgtgctagtgctgctggctaacccaggaactactagttaattgcacttgctgttactaggggcgttctctccccaggaatgacatggaaatgcagttacagtagccacttataagaccacccatgaacgaggtgaaagattttcagaactggtcctttgtcatgaaaagagcaagttagagtgtgcagatataatgggcaaaaagaaatctatgaaaacagaaaaactgacagtacagattcttttggaatttaaataattttattgtgaatttatatagcccccatccttctaaaaacatattttgcttccctctttctagttaagccaaaaaataagggaggagtgatggcatcatattttacttgtgaaaaatctggaacttggcaggtgctaacattaattgaatgcaaaatagctttaagctgatgcatttccctgacattgaagttaaaacatgactttgggatgtttgtttttatttcctttctgaatttatattccaagggaataacctacagaaaaagatatggctcatgtcctttttgtcttttttgtcctttttgtactcatgtcctttttgtattattgaatttttaaaagtattgttaaattctccctcctaatttctgctcttccaattttctacttactgtcacctctaagagaaagagataagaccgtctgaaaactgcttatttttaaatctggccgcccttcgaaatgaaacaaaaccaaacatagcaacagcatgtttttggttattgtaaaacaatttcaaaaatggtcttgtatttctagcacctgattttttctcttgattataagattttaatgtatgaagagaaaactcacatctgtgttataatgatacggaagtttgcttagttgtttcttgattttcttactggaaattaaataaaaaggagagaagcaaaaccccattatttgggcccatgacctggcttcccacctacctttgggattccctgattgagtggcagcagtagccgttctgaatctgcttttctcattttaacttggaccactgaacaggataaaaacatggaagtataagctaaagcaagcttgtccaacctgcgggccacatgcagcccagaatggctatgaatgcagctgaacacaaatcgtaaactcttttaaaacattatgaaattttttttgcaattttttttttttagcttatcagctatcgttagtgtagtttatgtgtggcccaagacacttcttccagtgtggtccaaggaagccaaaagattggacacccctgagctaatgtcacctccagacatacataacttgtgggtctgcatatttttcttctgtacaaagacctcttctgtaggtggcagtcatctctccatccctgctacaaagacagcaaagtctatgaattctcacaggcctagactcagcatagacatcaggcagctagaacaagcgtcagcacgcagtttctccccttctcctctcagtttccctgaggtcccaacaccggaatggctctgagcttctgcttctcttcgatggtgttttattccttcatcgcgtttgctttgaaggcatgagcagcctgttggagggggcgtgaaggctgctgggccggctttactgtcctgctctcccccgaggcccttcacctggggaagcttcgtcctgggctctcttgctttgccgggatggggtgggctgggaggatctctcttcacagctcacagcctgcatgactgcacgggtggcggtccctgtggagaagccaggcctggtgccgactgctttgccttggcgtgttaccttcaccacacggctggatggcggtttggaaatgcatgtcagaacagtgccttagacaactgcctttttaagaaatttcacttcttgcctaattttctttcccttctgtctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtttacatccccaaacgcagcctgcttagaaacagtcctggtcttgcctgtttggtagccactgactgctgatgtctcctggccagcagtttggggaggtctccactaccacagccgccctgatctcctcgagcacagggctctccaccaggactcgggctgggcatgcgcccctggcttgagaactttccagagaacattcccattggcttcgcagctcaccaggctgtggttggaacctgagaggtacattatgctccatttccttcactcatgattacgaccagctgccccatcgccctcatttagactttatctgcatttgctgttgggttctctcttcatcttgtccgctgtgcctgccgaaaccactggtctttggtaagaaaactcctttaccttctccacctgcttcctagaacagcccctctgccttcctgtggatggagagctagcctgcccctgatgatactcctgtccttctggctttctcaggaagcagcggcacccacatagggaggctgcggaaggggcacaatctgtgtgctttccactggtcccgagagagagtggcctggcccttctcgttagttcctctacccgagtccttctacctcttcctgtcccttttgctttattgcctggcctcgtggacttcatcacatgcttttagcatttgagaacctggccaggatggaaatgtcctattaaatgttccttatacataaaatgatctgaggaaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggtgatataagaaagagaaaaaaagaaaagaaatatttaaaaaatctttacacattctttgaagttgtatcattgttttatataccactgagaaagaaaaaatgctaattataactgagcaacttggattataagatacatccccagcttcagagatgtccaagtgtgaaaaaccgtgtgtgtcttagaatccacaatacatagtagaaagagtgacatccttttcggatattgtgtggaaatgatttatcttctgattcccgaagagagtgaggttctgaaagtaaggggaaaagtagattgatttaaatggatcagatgatagaggttagaaaaaaattaagacccagcttctgccccaaacactgtttttacaacaaaaatgaagtatgcaaattatttttgtgcttaagaacctcccaccccagaaaaaaacatttttacccactggtttaattaaagcctttaaatgaaggcaaagaaaatatttatgtgacatttagatcagaactgctgtattatggtgcagtgggactacctaagcttttttaaagcacttttcctgtgtccatctgtctctaaccttttcatgctgtttcttcattgttaggaagacagtgagcgctactctcgtagatccagaagaaacacatcggttagtaccgtgttcattcattacttgggcaatttgattgaattctaatttatgcttgcagtggctgaagtatatataatatattcaatctcttaatgatgatatcatctcttaaagaaattaactaatactattaatgatagaatactgatattattacctaaataaagactatgaacttagcttttagcattttgacctaaatttgataaggagagtgtgtttgagaaatttttcagtattaatatattcatgacagctgtagtgctttttgtgccattgaatacccataaataatctgcatagtaatatacaccaatgctgtgtatttatattacccgtgagataaagaatactacttggatgaaattactttttttttttttttttttttttttgagacagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctcgaactcctgggctcaagtgatctgcccacctcggcctcccaaagtgctgggattacaggcatgagccaccgtgcctggccctgaaattactttttttttgagatggtgtcttgctctattgcccaggctggagtgtagtggtgcagtcttggctcactgcaatgtctgcctcgtgggtccaagtgattctcatgcctcagcctcctgagtacctgggattacaggcacgtgccatgacacccggctaatttttgtattttttgtagagacagagtgtttcgccttgttggccaggctggtctcaaactcctgacctcaagtgatctgcctgcctcggcctcccaaaatgctgggattacaggcatgacaccacacctggccctgaaattactttaaatccatattgcccataagcagacagagatccacaaagcccatgctgtggaggacctagactggtgtcccctgagatgtccaggggtggctggccccctcactgctgtgggttggggtcagttcccagcatccccctgaaacttgggcactggttcttcatgtatgttgtatgattccttcacggttgttctcgtcctttcttttaataggcttctgatgaagacgagcgcatgtcagtgggtagtcgtggaagcctgagggtcagtaaccagaatgatggagtttgcatggcacagtttctggtccaagccctttactttctcatccccgcattctgatttcttcttcattatccccgtggtctgatagtcaatatttaaccgatgagatgcttacttaaaatcaaatcaatgggggatgtttctttgttgctgtagagagatgatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatccgtaaggtctgccttcagccgcttttccttgtatcagttataattagatctctttaccactgataggcttaatggttaatcaacacaaatatggacttttccttaaacattccagaaaccttaataattatacttgaaaaaagtgtgagtttggggggaagtaaaatagaaaaactatgttttgctcagtgctttaaatcagtgaattaacctgagcatgtcagtttcttttactgcaggattgaaattacatctcaccgctagtaataaataaatctcaaagcagccactcgctttattaatccttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggttaatatgggttcaagagagaataggaggagagaggcacagaatcccaaactgtctctctcaaaatgcatcattttcagagccacaccctcctgaaattgtaggcacaatttcagatgtaagatgtgtgcacttacattttcctgggaaaagaatgttcagtttcttcagattctcagagggtctcctgaccctgaagagttgaaaaccattgcaatatgaacgagtattacggtgttatgtaacagcattcatttcattttcaatgatttttaaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttggagtatgggggtccttacgcctgggtgagatggtcggatatactttgctgtgtgaccttaactgtgtggtgtgaccataataacctgtggtatttccacgaatctcatgggtgctttgtctccagtttttgcctggggggctatgaggccaggagggcaggcttaccctgcagagtgagcagtcttcctcctggggcctccagggtgcagccctgatcctgccggaggggaggagcccaggcatctgtgcatgaacactccctcaccagatggcctttgagcaccagctgtttgccacgccttgtgttagcagctgtgcataccaagatgaaaaagatagtgtctgccttcaaggaactcaaatcagatcaagaattcccaaggcctctacatttgctttaaaagattaaatgtaaagccattttacctaatgaaaaatccattattttccagtctatatccattcaaattaaatgtacaatctgacttttttttttttttttgccagaaagtattctttgagaaaactcctaacttccagtaacaaaaactaaggctttagacataaactcagaattacttcttatatgtctctgacagtttctgtgccttatgctttctaaaagtctgtcagtgttatacttcaaggaagaaaaagttctcagaaagcacagctcagcattaaagtgattcgatactgaagttattgtagcatattatgtactatttcacctgaaggactttacctaaaagcagtttgtgcttcatttgctccagtgcatttcaaaattatttagtaaattcttgttttaaaaatgtatttttgtgtttgcaattatagtgaatcaatagtagcatacatctgcatagcatatttggtgccctgagcctcctgtgggacggctgttctgctcttaacagatacaagagcagaggctggagtgagtagctcgggagtcaggacaggggaaagcacaaagacagggcgttagattcagaaagcgctcttcacagagtatctgttacttacctacagagcactgcaagtcgctctggcaggtgagggcatttctgtgacactgtaactccagcaactctcctgttctttaaggaattcaatgtgttagcaacatatttctagattattactctttttatgttaaattcaaagtaaattttgtttaagagctagcccccagtgggataaatgtatatgttagcaatggtcaggaacacattttggattttttttttcggtcttaattcttttttaaaattcaatagaatgcatcagggatcgaactccagagttttgacgtcaccttccttgtttccttttccatctctaatgccctttacatgtgctctgtcttttgactcatgtagaaaagacatctaacattattcatccaaaaagttggcagtggacttttgcgtggtcccatgggaaggtcacagacgctttgataacactgcgtggtagccattagcattcggactagtcacaagttaccgttttcatagggcatttacccttgtatcttatttatcctgtattagaacatactaacttatgtgtgtcctctttattttattctctcttatggcagtgtttctggagagcttgttagagtgcctgttcctgagccctttctgtaggtatcctgattccctaggcagtggcccatgcttgtgggaagcatgccaggtgtccaggaagcaggtgtgagacccagcctgggagcatggaaccagcaaagtgaacaagcctgtgtaccacttaaagctacacagtacaatagagcgaagcttgttgaacatcagagacccaacttaagatgaagttaatatgctgcctatggacttttgttctaatattgttcagttaactgtcaatgccccttgccctcttatgccacgtaaaaacagccccacccatctaaatacaacacaaaaaaacaccatccaagaggagaaagttagcagtgttctttaagaaggtcaaagtacttctccctatggaggtatagtcaacaagatcctatagatttgggaatacattctaggaacatagcccaggaataggttccttatgatagaattccattaccacagacctggtcatggaaattgctttgcaggctttcctgcaaagtaacagtttttcccaggttttcgtagaaggctgtaagtggaaaggtgacaaatgagaggatactgtcatgcttccagcttgcccagccttctgctccgtcgctgcaggctgagctggagaactacagtgcaaaggacagggttccgccacagagctatgtatttcataagcagcagtggagagccagaggccttgcttatgtcatacatttctcttcctcatttgttagtaaagtcaaagtcatctaaaagtgattaacattagccttcattattttattaatttcttctggaatctagtttctgaagacataacaagggattgagatctaaaatttgcaagtccttgacatgcattttcatgtcaaataatcttgttgctgaagacatgaaaggaaattagtctgagtaaaactcttgccaatctccaaagatttttactattaaatttatttcagaaatgttttaatgttactcatagagttctcaaatttaatatggaaggatttctacactccttttgtttcagaacttcaaattgatttcttgatttgttttgagttacagcaaagataaatatatagtttgatagtcaaagttttatgaatctggatttataatctgtctggaaattcaatttttttttctactttaatgtcatggctgcaaaatatgtgctatacagcacccgtcccccggataaggaaccatgtttagcacctcccatatgccaggccccttccatgtggattcatgtatccacccagtcagctggtgattcatgagggcactgttctaggtgcttgagatactcattttcatctcatttaatcctcacgatggctttgtaatgtatttattattatgcacattttcacggctgagaaaacagatgttcaagtgcattaaataattacttaaggtcacatgacggagcttctttgtggaatttggactcatgcccaggacctgatggcgtctccttccatttttaccagttgtgtagactgctcctcctttttctgtcccgagagctggttttgtctctgatgcttgacagctctattttgaatcagcagaaatttccttatagatgaattaagggacatttagaaagcccatgctttgacttaagggaacctgggctgggaactgagaagagagggatgataggcatgcacttagtagaatcattctcctttattctggaggacacattatgaaattattaaatatgtgttcaaatttcattttgaaaaataaagtaggagggctggatgaataaaaaactagtatagaggatataccccacgatgaacttttgcgtttaactatagattgactagaaataatttctgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctcaaaaaaaaaaaaaaaaaagaaatgatctctgaatcttctgaattatggcccatagcatcacaatgtgccataattttcaaagaccctgaaccaggaactgaaaactcattgactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgctgttccctcctgagctgcgggggagcagacggcggcagggatgcagtttgggagctgccaggacttgtactgtcctggactggtcattcatccgctccacaagaaaggtcaccttatacctggctggttggtccctgctgatttgtacctgtgaattcatttgtgtactgatgtcagtttttctcttttcttcattgaaacagacaaatggttatgatggagaattgtatggatcacagtccctgaatagaagatctggcagggttagtatagtaaatttgcatggctcaaaattcaaataggttgtttcaaagcttctagaactaaaaactaattgctaaatttaaatttagcttctttgctgtttttaaattttaaaatcggtctgtcttttttttcctagcacatgatggaatgaaagataatgtttttcaactagcaaacattctgagaatgttagccctccaacattctgattgttagtataaggggtagatattgataagaatctcaagttttaaaagatctgaaattaaagattaactctttcattactgtattcccctgggtgtatgtatataatgtgtgtattaagtatattcagctttcaaagatactaaatccaacattttcgcagtctccacatctgtcatttgtaattttaatgtttaccttaaaggcatgtgtacaagcacctgtgtttttctggagaggaaaaggagaataaaacaatgcagatgcttggaaggctcccagttaaggggtgggaggcaggaaggagctggtggaaggaaagggtgctgctctagggggagagagagggagtggtgccagtggcaggggcattagggagaccgggcgggggtggggagggctttggattaatcaaggacaggaggtcattggggattttagaaggttacactggatacatttccattaagcttcacgatatcccacaggtccattctgtgtgaaatggtctaaaaatttcctgttctcatgcttcatttttttcttttagtaatattcctaattgtgtaaaatagtatttcttttcatttatcttaattatgttatattaagatatcatgtgtatgcttaaattatacttttgggcttcaaatgagtgaccccacccagaccttcttccctctccccgaccaaagccgtctttagctttctgaaaccagctgatcaagttgtttttacttgctcattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaagtgcttgtcacttaaacgtgttttcttctttggtgctcagaattccagctacagcggtgacagcagattctctactttgtcatcatccagggaggagaagttggttggtttccatttaaatctttcacattctcttcagaaaccgcagattttgtagcatgcaatcttgtgtgtgtggattcagctctacttttctctttcggtgtctgtttgacggatttttgtttgggtagctgtgttattgacgtgaaaagcagcagttaacatgagctccttcattcagatgtactccagtgtgctgcgtttgaccacaccagctcgaatgtgaattgtggcattcagctggctgcaatgaaaggacgtgtttttgtgtatattttctaattagaattaatcaaaaggaaaaaaataattagaagaatgctcttgaattcttgagagtttctgaaaacagaactactttgaagagtacatgcaaactttgtggtggtttcttgggcatggactagacttggaaggaaaatccagagtctcatccaaatccacatgtttacacaacagagttccttcccattctctacaaacatgcatcggtcttgataaacataatttctaaattgtttaagagccctaaaattgctaaggcttgttggtgtttgtttaggttcacatttactcagcaaaattgggactagtttaggtaggaaaatcaagcaggccctgggatcacaaagctaagcagaggaggtgggtgctctccaggcactgacatctagaacagaagccaccggcaccggagaccagtacaggagtgaacagatgagtagatagaatgggagggagacactggttttgccaggaaaaaagatgtgagctgaaccttaataaataggaagggccaggtgtggtggctcacacctataaatcccagcacttcgggaggccgaggtgggcagaccatgaggtcaggagatagagaccatcctggctaacacgatgaaaccccgtctctactaaaaatataaaaaattagctaggtgcggtggcacatgcctgtagtcccagctactcggggggctgaggcaggagaatcgcttgaacccaggaagcagaggttgcagtgagccaagattgcaccactgcactccagcctgggcgacagagtgagattccatctcagacaaacaaacaaacaaacaaacaaacaaatagaacaaatgaaaagaataggaactaaccaggtagagcctagaggggaagctcttcaaggtaagtagccatttgagcagagcagaggccgcgcagaatgggcagaacccaggagaggtgccatgtggctgagcacagggtgctgttggagctgttccgtgaacctggtgactccagtagcagctcccacgctgaaatcagaaaatgaaatctatgcaattcctctgcgatttcctttagccactcccatgtatcattgacctcattaaaatgcttctagaagaaatagctctgacccttccccgccctgtccccaatttccagcccctattctcgtttccctcccggggggttggggggtatctttttcttgccagggcacttcttcctcacctcttcaccccttgtccaaccccttcatgtccagggagactgcagaaggtgctggcagctccatggcgcccactgcttgccacctttctcaacccttcccatagtcccccagtctgtaataaatccccccactgtaagctgatggcccttctgtcccccaatatgtgaattttgactcagtatatgatcagctgtgaacaccaaagcatcggtgggtttaacaccttgaaaaaggctttgggcattttcttaattcaagagattttgctgttgcagagggcacttagtcattaagaaaacttcatttccaactcattttcgataagctgagttacttgctctaaaataaaagatggcaataaatatctcatctttggatatgaacgattcacccaagttcagcctgcatctgactcacttcagtccatttaagagaaataacccacatccaaagggttaaacatcagaatgagagctgactcattcaaacagggccacatgtgaactcgccctgagccctgtgtgcccgtgatttgctgcccgagggctcttgtactcacccaccctcagaaccttcctggaaattgtgctctgtagacatctattgctgcccagtacgtggtgcgtttaattttatttaaatataataatggaaaggtatcagtgtagaatgtagtattgatgactcttcctaatatcaattaaaatttatttcaatatttaatatcaactaaaattaaatatttttttctgtgcgtgaactcaaaagtcctaatttggccccatctcctagttttgtcagttgcctggcccagccgtctttatttccttctgaccctcgttctctccctcccccgtgagtgcatgcctgttactgttttggttgtataaggtaatcgtctctgaactcactggactgatgtacctttgcgatgccgtgagggtgtgagcctctctctcctctctgctgcccatttgctctgattacagggactctccggctccagccttgggcttgccggtggtggcctggctcccacacccctgtctgccccaaatggaagctgggtctgtctccttttcacatcactttgtcgctccttccctttccttctgtgcatcactttaattgctgattacatttagtggatagttcagcctcctctacacaaagtcacaagagcaaagcttagcaactgttttaattggcttgactagtttgctaagacttttgtcaatcttttagaaaaaccatgtcaaataagttagaacctatatagaaaaggagacttaaggaaaaggagggttttattaaatgcatattttcaaaaactcgagtccaaaaaattggtctcttgggtctctcctccttttccagcaattgttccccatttggggtttcatttgtttttttaaaaatattttttctcttgtaaatgtgtccaggaagcaatttggaaggtttttgtgcctaatctgcctccttggtccctgagaagtggacagaacagtgttattcctttggctgggtctccccgctgtttcctgtttttacaaggtcaggttcaggtccggccctgaggtgcttggcctgttagctataggtatcgagtcttattctaatccaaggaagtcggtgtcagaggtgaaagtacacgtcctatttggaggttgaactgtccctctcccttgcatgtcgactggagctgctgagtgatcaccgcctggccgtgcaccttgcctgacttgctcagtgtgccctggaaatgagtccagattctgtcccgtggcacagtctctggacactgggagctgcccttgtgtcccagcctgtcccttcaccagcactgcctccccctgacgtgtgtgctaggcaggattctcctttgacagggctagaccgcggctcctctgggggtgcctcccacaccagctgaggcagccttgcagtgactccctttgtgtcttgaagactgtcgctgggcccctggcatagaaataaagactcttcctgctcctgtcttcatgtgtggacatctgcgtattgaatactgccaagtgtgtcgttaaccttggatttgagctgtgggttttgttgctgttgttgtgttgaccttgtcaccattctgtctcatcccctgaccctttcttccaggaatgcctgaaatgactagaaatgatcgtgttttaaagatgctgggaagtttactgttttaaagttaaaaatcatctcagttatctttcttgtaaattttggatttgcatctatcaaatttgcagaaaacacggtgcctcgatcggtttgtttctgtttaaccactgtacagcagttggctatggtgaatgctgaaactatcgtgatggccttttgctgtcatttgttgctgttttttcaaggcttttaaaacctgccatttgctttcatcctccagccctcctgtctgtacagcgctgcccggccttcggggagttaccgggtgcgtgtgctgcccaccctgctgccccgcaccccctcccactgtgcatgcaccgcccccaccaagcccagagccggggatgtgcctgttcccagccccctgggggaagttgcaccttcacgtggagcttacatgtgccagtggggaatgtctgtcccctttggccagatctgggttttctctcccccgattgttgactgtagctgccacactgctctgtctccaggaagccttgtgtttgctgggatcgttaggcaggaatggaacaacagcaatgtttactttacctattggcagaaagaatggtggctttttaatgctttggtaacctggacagatactaatccatgttactatattactttggaaatttccagttttaaatataagtacttatgctatgcaagaaacgtaaagtaaatactcaaagtagctatattgtcttgttaataaccttttttttttttttttttttttttggagacagaatctccctctgtcacccaggctggagtgcaagggcacgatctcggctcagtgcaacctacgcctcccaggttcaagtgagtctcctgcctcagcctcctgggtagctgggattacaggcacgtgtcaccacacccagttactttttgtgttttcagtagagacgggtttcaccacgttggccaggctggtctcaaactcccgacctcaggtgatctgcctgcctcggcctcccagagtgctaggattacaggcatgagccaccacacccagccattaataactttctgaatttccatcagattgcatacttatgtgtttgatatattaataaatggctgagcaaactagtatgtcctcaagggaaaatagggaaattaaagttcctttataccgggcaaagtttgacatcaccatttgtggcagtgtaagctcctgtttacccacgttgattaattaagtagcattttccagttaaccaattactctttcttctacttagcaacttttaaagggttataaaatatttaacattaaaactataattaacataatttgatattttatcccaaagtcacttcacataagagtaattttctaagcatcaagtatgagaatgccatgacaaaattcaggatgttcgaattatctgctcattttaacctggattaacaagttttcacttaggcctgggatgttttccaaagtaatagatttaaatggtctgttggagattacattgcacacctcctgacaacgactaaaaccggtctctcctcatttccttgtcgcactctgcaaccctttgaagagctggaaaggtggttctcagcctcccctgcatgctttttcaggtcatgctcctggcacgtgtcagtttttcacagctcacgttttcagcactttctgggcactcttggagaaaggaagagcgcccatcctgacagtctcttttggtcgcaggcgtctgtgttggatgaaggcagcttcggtgggacccgacggggcagcacctccggctcccgtgctgtaaggcgctttcggtgatacctcctttcccccgtgcctgctgcatggcctggggatgctcgctgggcagggtccagccgtggggggtgactggccattctcaggaggaagcgccgagtcaccgggctaaccgccaccttccattgtaatgaaggtcacaaataatgtgaatcaggaaacctctggttgttggtttcatgtcctcactcatcagggagagtaacttgcactgagtttcatctgctctctctgcagcacgccaaccatactaacaggtggtgaaaccgtcttcggttaataaaaacgggaaaaggacaacttgacagaccacacatcattctcgtccctggatagttgaggaagaggaacaaattttaaaacttggaatgttacgcatatttcattccctgtttgtattttgttgtctctctacctctttcttcaatttgaaatgataggctcagctatgagggtaaagatgtaataggtgcaccataaacatttgtgaatgaatgcgtgagaaaagcaacaaggtagaaaaatgagatggaacccgtggaagtggggagacgaatttgcgtgtcccagggacctgtggaaacggagcgttcagtgctaaccggtgctccctggcggtggatctcctgtattcagaggctcctccccaatcctataaaaatgtcttcaagccctccaggaaatagaaaggtttactaagaaatacttgaaatgcttttataattttgcttttgaagtttatcagctacttacttgactaaatccagttttatgacttactatgctatttgtccagccatcatggatattcatgaattcttatggtgtaagccagtctaacctacagttttctttaaaatgtaatttatgaatattaaatccagtagttgacatagcattcgtttttgtcgacaactgattacacatttatcaacttttatattacataagttgttcagtattttgcagcccactatataacatatttttcccagttggtaaacattttcataggccattagaaagctcataaaccatgcatgaagaatgaaatagccctgcctatgatgtgatggataaagcacaactaatgattttcttttgtcagaaaagagggagaatactaattcaagagaaatttcccccaagcaccaggtggttttctggtggcttcagtagagagtctaagatctggcaggacggagggctcctgatgctctccagatgctactgtgtcacgtctgagatgggcttcgggagtcgtcagccctagatccttggccttcattgctcttctgcgagcagtgatttctgtgcttttagcccccacaagaattgcctgggagtgatggccttagagagttaagaaaacaggaggtcatcttgtcctgacagcacagctgcctaaaatagggatggtcagctctgctgtgagcaggaaattagcaccatgaggaagacggaagggacaaagaagttcctgacctcccaacctctgccatcgtttccctggaaccctcacagttcccctccaagtggatactccgttccttatgtttacaggagggccttgggagagagccacccctgctctcggtccagcgtgtagggaggttatggcccaggacggtgtccagagcggccccggcgcccaggcctgaggtcccagccccaagtggtcgtgacctcagggtccaggcttcccccaggcctgcacagacagccctggtcctgctgtggaggatttgccctgcccctggaggaccaggaattgcccccgcgcagctcctgagtgtgaagtgactttcttcggtgttgtgacaaagctgggacgtagtcatcaccagtggcattgtctgatccaggagccgaggaagttgtttctggcagaaagtggaaataagaagcccaacatgtaccccctttcctagtcctcagctcctccatttggcccacgtccttacttccatgtcacagatgccgggctaaggaacttccacagccacgtggccaacaagagatggagccatgattcagacttaaagctttctgacttctgcacattagccacataactcctaaacataaggtgcacgtggaccgtggcgatatagactttcactttgttcttttctgcgtgattaggtccagttggaaggtttgagagctgcttttgcttagggaagctggggtgggcagtaagctctattcacaacagttcactgtgtctttgcaccataaaccagggcatgaatggcataggatggagaaggatttgctgcaggatgaagttttcctctctcttacatcaggaaaccctcaggcaaaattcttctgctttaaagtgttgacattaagtgttttccttattttcaacaagaatgccaaaaagtgaggctagtaatactggtgattttcttgtatatctcaaatgtggcattgatgctttacatgtgctgtgtacacagcagtattaatctgtgaatctgaaacaacgtcttgcccctgagtgtaagtgtatagtaaacatttatcaaataaaatagaggtggatgggtctggggaacttgcccatcttgtccacagccctgtacatttaatgctttcaattgacatttgatggttattttagtctacagttgaaatcattcgttcattcaacaagtatttcttgagtttgccaggcctcatctggtcactagccctggtgaggaaacaaactaagagatggtatttgacatgagatcatgagcacccctgaagatctatatgagatcacaagcacccctgaagatctggatgagatcatgagcacccctgaagatctggatgagatctggagcacccatgaagatctggatgagatcttgagcacccctgaagatctggatgagatcttgagcacccgtgaagatctggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctatatggtgctgcgtgggtctctcttgaagatgctcctcaggacatgtcgggatcctaaatagtgttcaaatcctgcccccgccccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatttaaaaagccatacataattttgtattaaccctaactctcattttgcttccacttggaaagatagtggagaagcaaaatttttgttcccttgctaaagcgccaagcgccctgtgcaagtcttcagtttctgtgccggaaggcagcttaagttctcaaaacagtcatttccacatccacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggtggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaattgttagctgtgcttagagatggggatcttagaggaggcaaactttatacaaagggagaaaataatatagccatgtgcacggatgtgtggttttctttttatgatttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgacacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaaagatgggcaaggcttccctgttcgtctccactcatatcaaaatttccagcctgagctgggtgtggtggctcacatctgtaatcccagcgtcatgggaggctgaggcaagaggatttcttgaagccaggagttggagatcagtttggccaacatagcaagaccccccatctctaaacagtaaaaaaaaaaaaaaaaattagccaggtgtggaggcacgcatctgtagtcgcagctactcaggaggttgaggtgggaggattgcttgagcccaggagttcgaggttgcaatgagctatgagtgccactgcatttcagcctggacaacagagtgagaccctgcctctagaaaacaaaaacaaaaacaaaaacttctcccagccatcgagaagttaaaatgtggctcttaagttagttactgaacaccatacttcagcgtgctgatccctacaatttctgtaacgttcctagtaatcaaccaagaagtcgcagcgctgagacctcctgcttgcgtggatgtaccttttttggcgggcttttcctattgtggtgctggtggtttgtttgtgttttaaattagatgcagtcttttaaaactgtgaggtttcctacctcgcacctgatacctgcattcaggtatcagcaaatgcaggtatcagcttctttgggggaagaaaacccaggatctctggccacttgactctgaggctgccttgcagaactgcacagcctccaccccacccactattttcgtgaccccgaggccacggcccaggtgccattcatcactgtgcagcatggctttcctgtgctagaggaatgtttatctcctccatccagccatggagagcaggaaaatagagttcaatatgggtgggcattgcaacgccagcgcctctttctctgggggaagactctcccctctgtataagttgcagacacccactcttgtcacacatttggctctgcccacctggcctcacaggcatttgagtttgtgttccacccctccccatcccagagcccagcagtcagcagtgagagaagccaaatgtgtgcagggagtgcgaggcggcagctaccatgcaaactccaggggcacaccgccccccagtaatctctccccagagtgcatcaggcaataacaggaagatactcagctgttcattatgacatgatttcccattttcaaacctgacaagttggtcttgatgctgttattcaaataactgaaagtaaatggttgtgaacaaggaatttcagatcacagactcagtaagcctggccagcccccaaggctgtgtcttccttaaagttgggatctctgtattatctcatactctatagtagagcaataaacataagctgacttatgtgatcacttaaaactaccaggaagaaacattttccgtaataaatttagtgtaggattgctttgtcttctcacactcacttttcagaaaagaaaatgtaagtattgccaggcgcggtggctcacacctgtaatcccagcactttgggaggctgaggcaggtggatcacttgaggtcaggagttggagaccagcctggccaacatggagaaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcagtgagggacaaggctgtcccccatctcatcctgggtgccttacatctgatgaaacctcccgtatgtggttcttagaatgcagagaggtctctgtagagtgcagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttgggacatttacaccattgctggtatattttggatctcctgggacaacagaaagtgctagtggttgtgtttggccttgttgatgggaagaagccaggagagcctggataggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatccagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaaggaagtgactgcttgtcccacttcgagaaaatgaaaatgcttcagtgtccagagaccaccaccagggacaagacttcaagttttctccacccacttggtcctcccagggtccttgggaaagcagagagggcatcagccccatctcaagacaggcatagaatactgttcacctcattctcatcttctcccatgctgtggatgagctgtgttttcttcctctccagcacgaccaggatcttctccttgaggaagttatttcactcattcattcagtgtttattgagcacctagaatgttccagaaacagggccgttgtatgagcaaatgcagacttgccccagccctcatgggacgcacagacaggggcagacggatgcttgttgggtgatcacacgttgtgaagcccagcagcgggggtgtgaggggaggcaaaggtgcctcgagagagctgggatccagaggtttgacggccagagcttgggccacacccaagcagagtgactccacctagtgaagccaacagatctgggtcatccaggccccaaaatctcactgggaacctggtgaagccatcacgtttctgaaacatccatcaggaatgtcccaagggcagcctgggtccatatcttccctcgtgtactcagagaagacaggagcaatgaactcagatctctgcccatttggactagaaaaacaacactattttgactcatgttttttgttgcacaaagaggcaggggcagggaccaggtggaaaaacgggtcttgaattacaaacaccagagttcaaagataagtcattcaggctaaagtaaatattattggatttaaaaccaaaaaccgtcaccctagtggtggactgtgctatcatttaaatgtgaaggaaaattacccttaaaatgggtgttttctgagcagtgtttgctgtttgtttgtgtctcaagaaggacctcgcaaggatgttgcttcggtgatccctttttccatccaagtctggtgttgcctggctgggtgttgaggacaggttccttttgtacctgggcccttgagtagggtctctctgggtacgtgaacaggtgccacatattctttctttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcctgcggcttctgtccgggcccggcccctgcagctgtgacacactgccatctggtggacacgagtggggctgcgtggctttccacggggctgaatagccttcctgtgtttgaggaaagctgacaaatcctttttcattcggaagacacacaaaatgaaatttactctactatgtaaaatagagataggttagacgttcatttgccatcacctttcaacaagagcttaatttttagtttttctctgcatggtctctacttaaaaatatgcccagattttattttgagtccgttgtgttcttcggagcaaggacttttttaaaatgataaaaacagcaaactatggtttttggggttttttcccttatttgatattttacaaattataaaaacaaatgatgtagacggttacaagcaaaaccatgcagaacaaagatgtgttaaagccctgcccccccaaaatcaaggtttgtggaccccgtgtgttttctttctcagctttcttgcaagaaataccagaaagaaaaaagggcttgggtgggcccttcttttacggtctcagatatctttgtaggtaaacgaatgcattcctggagcttcatttatttctccacagtatttatccattgctgaccagcagccagaaaacatacgttttacaccgtggagcaaacatgccacaggcttttcagtggtagtttggcagtctattaaactggattttcatatcccaccaagagttaaactagcctctttattttcatcttattaatatttgttcagcaaactaacttactctaaggaataaaaggctttgggcccaggagatttaatgaatttattctccagcacgctaagtgctagatagatagttcacatttccttgttctttgaaattttatttattttattttatttattttttttttttttgagacagagttacactctgtcgcccaggctggattgcagtggcatgatctcagctcactgcaacctctacctcctgggttcaagagattctcctgcctcaacctcctgagtagctgggattacaggtgcatgtcaccacacacagctaatttttgtaattttaatagagacagggtttcgccgtgttggccaggttggtctcgaactcctgacctcaaatgatctgcccacctcggcctcccaaagtactgggattacagacaggagctaccgcgcctggccttgaaattttgatttgaaaaatatttcaggaatatttttctttccatgtgaagttgagaaccacacttgaattgctccaatcatcctcacaactcaacatggctgcagggcttctggggctctgccaaatgagatggtgcccatctgatcagagtctgccttcgtatctgtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcattatgaattatctctgtgtgagctcacaacggtgactgcagagtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagtcctgcaaacaaacaaacaaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagtgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacctggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatggtagggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaacatctgagaataaaagtaccatactctttgccaagtgacttgaaatattgatacgtataatttcaacatgtaaactggagacagtttttctaggagaacatctaagctaaaagcaaaaccatgaaaaaacatacctatgaaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagagaggaaatgctcgaggtaggtagcattctcctgcttttcttttccttttttccctttggagcattttgtcaggccatgactatcttagcttaggctgcagtaataaaataccatacacagcatggcttaaacaacagaaattaattttcttacaattctggaggctgggagtccaagatcaaggttgggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggtttccccaaaatggtgattcctacacatagctctaataaagacgtcgagatacctgcacaaaccatcggcacgttgactcaagccacactgtgtttccactgtcacgctcatcagcacttaggagtgtgtgtgtgtgtgtgtgtgtctgcatgcacgcacactttaggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaaaaaaaagaaaaaaaatccaggtgacaacagcaaattttgggatgctgtgaatatgtgtgtacataattcattttatgtcatttagttctgttaataattcatatattgggttaactgacagcgatgagatgtaaaataaatgtaggttcagtgggtggtgcccaaggccttttgatgttaataaacatagccaatcttgaatgcaagaattttttgatacattatctaaatttttctcatactcactagtaaattctccaggatattactcagacttagagaattaatttgcctctttatattaaaacccccaatttaaggacttctctagaggaacagtgacttgggtaagtggtttgggcaaggatcccgctaattagactttgagacctactagattacaggtggaagacggttccctgtccttggtgggccacgccaaggcgtcttcagccgctgcttgacacaggtgaagcgccagtggcagcactctgggtgggggggttcctgaaccgtcaccatctgctgcttggcctccagggtcaaagccagagcagtgagccagccagctacaggcttagagctaagattcgtaattctgctccttgaagaggcgatcagttcaggggagttcctcacacacaagggagagagagccacaggcggcaggagggcatgggtgagtgatgtctgcagttgggaagtgctgctgttttcagtgaattctgtttcttttgaatatactgaacattctagccacctctgaattccttctttaacataagtttcgtgtgtctctttcagaacatgtatatatttctttctttatctggtttctctttttaaagaatgcaatcagggttttgaaatgaaaggtcacttggcagtgacttgcttactgctccacttgggggcagcccacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccgctcgaggtgggcaggcggccgtggtagtgggtgtggcggtgctgagagtctgagtatgcccacctttgtcagaggggatcctcctttgtatgccacgtgtttgcttctgaaagaatataaaactggggaatccagtagatcagaggaatattttataccattttcaatgatctgatttgtcataatttgtcataagagttggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatggaaatgtagacacctccaggccccatcttctcaggcctcgcattccagggaggtacctcattcattatctttatgactattaaagaaacacagctcttttcaattgtgtaaaaaaagttgtggcctagtgcagtggctcacacttctaatcccagcgctgcgggtggccaaggctggaggatcacttaagaccaggaattccaggccagcctggcaacctagcaagattccgtctctagataggtatgtagtatctatataccgttgttgagaaaagataaattaatcaatttccatcatacctttatatgagctacccgaacagctaggaatctgattacgctgctcttactcaaatacacattttataaatctttgataaccattgtgaaatgttgtaagaaccagaaatgtcagttttgaaagtggccttcaaatgacttttgatcacatattccttcagcaaagaattgtaggatccaatatgtatgtttattttaaatctacatatgtatactatttcattaatataaaatgtacgttataaaatatatgcaaagatatgcaaagaagttttagagtaaaactctaaatagaattcctaatatttcccccattttccctgggatatgggcaccccaccatggagatcactgggctataaaattatctagctttgactttcagtaacatagtaccatatctaatctgctggggttttgtttggagagtccaaaaattccaaaacagtttgatgttctttagacgatgaataatttatcatttaatttagtggtcatcttgatcttgaacatttgcctcctgctggtcctctctccctagtcccttagggaatggagcagaggtatcagggcatggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcacctttaaaaatctgtccacacaagatggcaccagcagccactctggcctttgatgtggtggcagtggccctcactgacccaaaatttactaatgcaactgctgctttgccgcacagaactggcaaaggcttgtttctcatgactctttgatgactctgtctttaggaataggggtgggtgggatttggaacgtgtgtttacattctaatgtagattatgtggccgccacatcatggggtcccttcaattttctcaatggtcttttaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaagcctgtggttccactctttgggctgcttgaagtctgagtctgactactgttgtatgtaataccacctttgagtaatatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgataaatgcttgctaggaaataagtccaagggctctataggacttcacagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaatatacaaacaattagccaggcatggtggcatgtgcatgtagtcccatgtagtcccagctacttaggaggcagaaacacctgagcctgggaggtcgaggctgcagtgaattgtgctcacaccactgcattccagcctgggtgatggagtgaaaccctgtctcaaaaaaaaagaaagaaaagaaaaagaaagttgacttagctatactccatataagaaggtatagaaatatatagagcaatttagaaagattatagtgtcaaaagattcaaactcagaaaagaattgaaaggttgcctgccagccatatccccagacgaacctagaccactggggtttcactatcatacagaatagagaaaaacattggttactgacacctgaaatcaaaaagcttggatatttttcagtcccaaaccagaacatagctcccgtatataaatgtaaatcttccttcaaaagtataattaagtataattatgggtgtatgtcaaaaatatagaggaagatggatttttacttataggttgttatacaaagttgggacagcaatcaaatttttaaacagttttcaagaatgtatgaccttaaaagaaatgtgtgaccctgatcactttccatatttgtaattaaccggagacctaatggtctgaacacttaagtttccactatcactaggaccctgaatgctaattctggggagtttagatggtttggggctcctgttttctattcatagactccctttctgggagaccaccccccaaccctgtacagcgtaccacccgtggccaccagccaagggaacacaacagtaagatttgttctaaacgtctgggcccctaagggaaagggaggggtgtttgtgtgtgcatgtattatgttcagaatatgtacttgttcagtgtgatagttgtacgtggagaaaactttgtctttcaagaggaaaatccttttgttctttttgtccctatctactgcctctcttaaatatttttcaacatgtgaatggctggtggctgatacagggaaaaatttcccagctatacagacactataagtctaccggtgatgtgccactatttattcaacaatatagacttggtggtttttaacgctacgaaaactagtactctttattttcttcatgtcaaattattttgcttcatttctttttccattttcttcaaactctttcgttcttgttttcttgtccaagtctcctttagaatttctcttcctgaaaagtttcttctctatttataatgttctcactatacaactaaatgtcagattacctatatcaattttgcttgcactcttattacattttaacacttattttctagtgcttatgtagaatatttgaagttttctagaagaaaacaataacaattgtacaatagatacttgagcttcaagatcacattctggtgtattcagtgtttcttatgacgcctgtagtttttgtatgtaggagtattaaaacatgtaagaaaatgaaaagtgatattgggcaaaagaatcaggttcataactgcaaaaatgttttgtttcaatgttgggtgggttatgggggggagcgagtaaaacatctgtcagaagtaatttgactgtaaattaaaatagaactcaaaaggatgataaatttaatttatattgtgcttaacattatctggtgtttactgtgcctttcaaaacaacttaggatctttggaaaacataattagagaaaaatgtaacttggattagcatgtggctagatgattttttaaatgaaaatgaagatgcattttatatgaattattttcttttcacatggctaatcaaggttagtttttcattctatgaagaatctggaggtaggccgcatgacagcagtgtcctagtgagctaagagctttgagtcagggtctgactcgggcgtgtgagtttggatctggaaaaacagcgggtgcagtgtttaggggagtgttcccgtggctgggccgcaaggcctgaagaaacttgcttagtggttctgggcctctgagcctcatctatagaaggaggctatgatgaagcctacccatagggcttctggggctgaaacgagctaatgatgtcgaagctgctagaactgtacctgtgtcagagcgagtgtgcagcatacgttatcatcactgtcatcactccagcattctgactgtgcctttaaactagtgtgggattttgcccaaacctctaaaccctcccctagccgtggtttcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtggtacgtgtataactacttccatcattcatttcactaacctgaacgatcattcttcagtttagcaatgtgctgaaaggcgcggcacgcggattcacctaaacctgtgtctttgtgatttctttagatattaggttgaaaaagctggttgatgaacgggaatgcttattggaacaggtaacaatctttttattactttaccggttcatgaacagggcacctgaaaccacctgcccatccttccttcttgcttactcagaaaacccctaagttaatcatgtctgaaagtctttatcaagccaactggtgttcttaagattgctatccaaatagaacatcaaagttaatattttcatccaaagagaacatcctgagtcatatgaggtttaataaggatgtctcaaagacccaaagccatggaattgaatttggtacattttactgaattgctgcttaaaataaatataaatgttgattattaataatattaatgattaactgttgagagacaagagcattactgagtcattccaaatagcacttctcttgtccatatgggttgtttgtccataaaagtcagttttgtactcttggtgatcagcacccctctctcacaggtgtttctttgttacagctaaacaaagttgttttaaccatgtttatcttcattgctctctcctacctcaagaagtagcaggccaggtgcagtggctcacacctgtaatcgtagcactttgggaggccaaggcgggcggatcacttgaggtcaggagttcaagagcagtctgccaacatggtgaaaccccgtctctactaaaaatacaaaaattagccgggtgtgatggtgcgcgcccgtaatcccagctactggggaggctgaggcaggagaatcgcttgaacccgggaagcagaggttgcagtgagccgagatcgcaccactgcactccaacctgggtgacagagcaagactccatctcaaaaacaaagaaacactgaacagttatcctatctgatctttttatatgcaggatagtgattaaatcactctacaaccactttcctctaatttctcctcataagcctaatcaaatgtatttgccttacttcctaccattctgttgaagattctccgaaaattggagaaagcactaaatatggtaggaagattctcttgaagttcctgtgatcttttgaaactgcattcctgagttctatccttacttccttaaagcagcatgcacttttggtttgttgttaatcaggggtctcctgtgcttggtgtgtggggtaggaaggcaggtgatcacctgcaacaattcttcacagattggaagttaaacatgaaaagcccccggagaccccacgaactagatgccagaaagttctgcagtcattgactgttaactgcaattccaactatacggtcagccctccatatccatgggttccatatccgtggattcaaccaacatggattgaaatattccaaaaaaaaaaaaaaaaaacccataaattccgcaaagttccaaaaagcatagcttgaatttgccctgcacggagtcctgcactgaatccacacaaatgaagtgagttgtaggcgttgggtattaaaaggaatctagaggtgatttaaagtgtaccggagaatgcaggtaggtttctgcaaatactgcaccattttatatcagggacttgagcatccacagatttggtgtctgaggggtcctggaaccaatccccccccccccccgcccagataccaagggacaactggacatgtttctgtcttgcttagagaggggaaagctagctagagaccaactccctgaaagctggcaaaccgcctctgaacacacctgcagctggcctggacgctgagaaagcactcgacttttgggggacttaattacaatatattggagcccagaaggctccaagtggccctttctggtttcttagtaaataaagagaaagtgaatagcatggtgacttactgagtcttaaacattgcaggtatttcatgtacagtctcctcctgagtcctagaagaatttcactttagaaatgacttttctctcagagttacagtgtaattcatttttcattcattgtacattgaattgtgtttctgagaagagtactgatggacacaaagtgccttctgtcatttgacatgctgcttcctttctgatgggctctaacttcagcttttcggtctcattcagagtagagaaattaacagattttactggcgggtgttttcagattaagaaactcaaagggcagctggaggagagacagaagattggcaaactagacaatcttcgatctgaagatgatgtcttggaaaacgggacagacatgcatgtaatggacctacaaagtaaatgtcaattcttgtgtagaagtaaatgctttcacatgtgctgttttagtatacttgtgctggcagagaaaactgtcacggcaaagaatgccctcattccctcacatccccacaaaagcccttaaaaataaaagcacaaggaggggtaggtagacagaacaatggtgtttctctctgagcctatgaaatagaacaggtacccaaaaacgtgcaccaagataccaccacatgttgtgccgatggaaaccacatttactttgctggatacagcaatctttcgatctgttgattgtatgaaaaaaaaaaaatgaaaggcttttttcatgctaataaactagaaacagtcttaagggagataaaattatgcccagtctctctccgcccttttccctaccccctaccatctctttgtcttcttcactcataggcactctcttgcctgaggtttcctgccccaagcacaggggcggaaggcactttccctgggttcatggggagagagtgccttctcctactctcagctctgggaggttgtggaggcagggccagaactaacagatttgtgagatgattacaaagtaagggcttggttcccagtaactattgttttaatatttgaaaagcccaagagcttaacagattttccttctctttcaacctttaggggatgccaacagacagatcagcgacctcaaatttaaacttgcaaaatctgagcaagagataactgcattagaacaaaatgtacgtgtaagcaacaacgggcagaactgatgattgactggagttttacttgctagaaatagccctgaaaggctgaggaccagaaaaagccgagatttttagaaccaagaaatgtcctaagagggataagttaagacagcaagtctttccatccgtttcttacagagcaagcaggaaggaaagaattcttagaatttaagttgttacagtagatactaatcctttatcaacaacagttagttgtagaaaatagctaatgtggcttgggagtgttttaaaattttgttctttaaaattaatttagttaattggccgagcgcagtggctcacacctgtaatcccagcactttgggaggctgagatgggtggatcactgaaggtcgagagttcgagaccagcctggccaacatagtgaaaccccgtctctactaaaaatacaaaaattagccgggcatggtggcaggcgcctgtaatctcagctactcaggaggctgaagcaggagaatcgcttgaaccagggtggcagaggttgcagtgagccgagatcacgccactgcactccagcctgggcaacagcgagactctgtctcaaaaataaaataaaataaataaataaataatgtagctaattaaaaaaacacatcatactgggacgtccctcttgcctgggcttttagcctttctcttgcagcgaggcccgccctccctggtgtctagacatggggcactcctgcctctagcaccctgggccctagggcaatttgtgttctagccagaaagagagaaaaaaaacaggactgtttccccctccattgtgggtgtacttggctggaactttttagaatgtttatagaaacaaaaatgagaacagcacaggtagagacgatgtgtgcttttgattgcggcagagtgaaggtgtccagcaggccttcgctgctgccgtctttcatctcagaaccttggctggggaatgccatgccgaagccgcctcctttcactcctcgccctgtcctttcctcctcccacccccgccaccccaggagagattagactggagctgaggtcgtggcggaacacgtcccttaccagcaccattctgcctgttccaacagaacagccccacgcagcgggagaagaagcaggcagcaaggtgccagcactgcagaaaccaccctggtggacggggtcagaggaaatgggtccccatcatgtcagcacagggtcgcccagaaatagtaaccaagaatagcttgcttggctcaaacccacaccatagtccaaaatgttataagtatttacatggtgtattctcccattttattaaatcacactctttgatctcaaagtaaagaaactgaagaaagaaaacaggcttatcaatttatacatatggttttttttctaccttttaggtaataaggttagagagtcaagtatcacgttacaaatcagcggctgaaaatgcagaaaaaatagaagatgaacttaaggcagaaaaacggaaactccaaagagaggtaaatttcctaggcaatttctaggaagagaatggctgccagtatttctctagtggggacggtacagagaggatttactactgtgacatctgcccctgggctggtcattgtcagatcatcccacaccactctgcagtgccggtgtcttaataaaggaaggcatggcgcagccagttagggcttagggctagacccttgctggcatcaactagttcatctgtcagttttgagcatctcctataggtcttgtccgtaaacgtcaagagaatgagataaaggagtagccaggcctcttatgctccgaatattttttgtgtcatgcagaatgagcccaggtggaggaccaggagcccatgggcctgctgtggccaagagctgggtgtggcaccagggccaggccacagctgtctcaggtcaccctatggagagtgcccttgagaagccgagctgctgttactccacctgctggtcacactcccaaattaccatgcttgccaattaaaacacatactttaccttactgaagacacttggcaaagttgtttgttcaacaaatatttacagcacccgttgcatgccgggcacgggttcaggtgctggagatgcagctgtgaccttacagacaggagtctccgcctccatagagcctgtgctctggaagagggaggtccataaaagtgaccacaggcaggagaggggctggggtgcggaatggcccaggccagggcagttctaggtaggtggccaaggaagactttccttcttgtggcatataaggacaggcctgaacagcccagggagtgagccaggcagaactgggagaaagccttccgcgcaaaggatcagcacgtgcaggggagctcggggcaaggcactgcctttgtcaaggaacagtcagagcggtggaggccaagtgagcagggggtgagggggtggagggagcagtgagagcacctcagcccgtgaggcagggccctggaggccatggacaggacttgggatcctcctgtgcataaagtgggagctactgcagggttttgagcaaaggagtggcttatgttgatttatgtttcaataggatcactcgggccgggcgcggtggctcacgcctataatcccagcactttgggaggccaaggtgagcaaatcgcttgagctcaggagttcaagaccagtgtgggcaacatagtgaaaacctgtctttacataaagtgcaaaaaaactaattagccgggtgcggtggcccgtgcctgtagtctcagctacttgggaggctgaggcaggaggattgcttgagcctgggaggtgaaagctgctttgacacatgagcgtgccactgcactccagcatggggcgacagagtgagaccgtttttcattaaaaaaaaggaaagaatcactcattttatatttaaactgtaggaaagggactgtggaggagaaaccaaagatgccatttctctcctctttattttatttatttatttattttatttgattttattttatttatttatttttttgagacggagtctgactcttgcccaggctggagtgcaatggcgccatctcggctcactgcaacctccacctcccaggttcaagcctcccacctcagcctctcgagtagccggaaatacaggcacccaccatcatgcctggctaatttttgtgtttttgtagagacggggtttctccatgttggccaggctggtcttgaactcctgacctcaggtgatcctcctgccttggcctcccaaagtgctgggattacaggcatgagccaccatgcctggcccatttaaccttctagcctacttttgctatggtcagagaacatggtccctgttatacctggtctttgaaatttgtcaatacttgcttaatggcctgatacatgattcacttttgtaaatgtctccaatgtggttaagaagaatgtgtagtctctgatttatggatgcaaaattctgtatacttccactgatcaaacttgtgaagtgtgcattcagatctgatttcttttgtctgcttaaattctcagtagctgatagagatttgtcaagctcttccaaaagatgatggtggatttatctcattctccctatttctcctatatatgttgaggctattgatactagatgtttaaaattctgatatcttcttgatgagttaaaccttttatcactttgtagtgacccttttggtccctgctgctgttgaccttgtcgggtattcacgtggccgcatcagctttcttttggttagtgtttgtccacttctgatttttgcatcccttggcttccagtcttccgtgtgttgttatgcgttagatgatctccttcagatgcacatagctaggtggcggtggctcttagttgaatctggaatctgtggatcttaatagagcccttagtccattgttattggtatatttggactcgttttcaccatctgactgtggataaccatttgttctgtcttttgtgtgtcatttttctcttgccaaatttaaattttatattcaatttctattcttttcagtgatcacacatggggtatttttatttaacttaaaaaaaaattaaagttgaacactatctttactcccctcctataaaatagaaggacttttgagcactttagcttcaccctcctgcctggcatgcacaccctcacacatatgtgtatatgtgtatatgtatatgtacacatgtacatccacacataaatacttttgagcttcataaatcccacttatcagataatactattgttgtgttgttgttgctgttgttttatattgcccatgtttgtttgacataactacatattggccattttatatgtctgtcctgctagtgtctcagactgtactagaatcattttcctcctcactgaagtacatactgtagaaattcttttagagcagacttcttggtggtgaattccctgtttttgtttgtacatgttttcgtttcatccttgttcttggacagtagtattcagggacatgcaattctgtgtggtggtcattttcctcaatgattatagcgattatgccaccatctgctggcttccattgagctgttgagaaagttgttgttttaacggtcggtcctttgtagggacctttttttttcttctctagtttctttcaggttctgtttgtctttgattttctacagttttactgttagatgtagtttattggaatctttctgcttgagatatatagtgtttcttggatctgtgaagtctttttaaaaattgattttggaaaatattcaaccattaactccttaaataattcctcttttttagtctctccactttcccctctggaactctaatcagaggatgttagagattctcattgtctccacattttttaaccatctctctttcatgttttctatctccttacctctctctattggataatgcctaaagtttttgcaaagattttccagttcaccattttttttaaaaagtgtcttcattgttgatagtttcttgctgcatgttcatgtatgtcctctttttaaattgtattcttattctttaaatatttcatacacagctgtttggttttctgtatctgacaactgaaacatgctcagtctttgggggtctaattctgtcatttattgcttctgttgactctcactcaaatggtttgtcaccttagtgttttgtgagcttatgcttgattttaatttgtaggaataactccaggcttaacttgtggaaacttcctgcaaaaagggcttgcttctgcctctgctagtgaggtggggtcgggacttctgtcccaggacccaaacaagcttccttgagtgttttgggtcgaaagcagagccatagaccctgttcttgtcacccctccaaaaccacgttctcccagcttagggcaccccactctgccctgctgcctgtgggtccagatgatgccctgctaatgtggcttctgcagctcgtcttctgcctgactctcaggctccatggccctggctcccaggtgtggccgtcttggcctcaggcattcctgccttggactctggctgccagggctgtggggaccaccttcgccatgcagtccaggctcagctcttgttgtttgtgtttgtttacctcatgcctcacttaccttttgtgaaaccatcaggatccccactgggcgtgtggctcacgcctgtaatcccagcactttgggaggccgaggtgggtagatcacctgaggtcaggagttcaagaccagcctgaccaacatggtgaaaccccatctctaataaaatacaaaaaattagccaggtgtggtggtgtgcacctgtagtctcagctactcaggaggctgagacaagagaattgtttgaacccagaaggcggaggttgcagtgagccaagatcacaccgttatactctggcctgggtgacagagcgagactttgtctcaaaaaaaaaaacaaacaaaaaaagaggccgagcgtggtggctcatgcctgtaatcccagcactttgggaggccaaggcggacagatcacgaggtcaggagatcgagaccatcctggccaacatggcaaaaccccgtctctactaaaatacaaaaaattaactgagggtggtggcgcacacctgtagtcccgggaggctgaggcaggggaatcgcttgaacccgtgaggcggagcttgcagtgagccgagatcacgccactgcactccagcctgggcgactgagcgagattccatctcaagaaaaaaaaaagaaaaccatcaggatccccaagggtgttccctctctggagtccagttgtttcagaggaggaagggcatcatgagggaccaggggccaagttatcattttatttttcagtaggattggaatttcggtaacacagaaccctgttatgtttggaggaaacaagttccttaaagctcactgcctttcctccgttcccagctccgctctgcattggataaaacagaagagctcgaggtgagcaacggccacttagtgaagcgtctggaaaaaatgaaagcaaatcggagtgcactcttgtcccagcagtaaattccagctctgatcaggcaactggttggtgactggagagcattgtttcataggcttttctctgtcctatctgggagcgctgcttcttcccctgccttccgagagacgaagaccgtggcgagcttggcgcttaggggctcccgtgccatggctcaccccagggagccccagcagccaccaggtgcctctgtctgcagacccctggcccgggctggcgccgacgctcagaacctgcaggtacttcataagcacacaggggcctcgagggagctctgtgtctgaccgcacagcagcctctgaatgccgctggaagtgatgatcaaagtaaagattcagttgggacttgagttttttttttttttcatgtgtcttgctgaagattaaggggaaatgttacagtgttgggacttcctttcatggcagaatctacaatttgagcgacttcagtagtatctcttagtctacgcttttcatacacaaaacactgtggaaccacaagccattaccaagcaaaactctttcactggaaacaagggggcagtctagaagtaaaagtgaccttaagaagactctttacaggcaacaaatgaagcttttctaagggatttttgcatcagttcagtcataagaatacttttttccagggtaattaggcaatagcttcactgaaaatgacagcttttcattgcattatttaatccttatatttggaattgaagtcgttaacttcttttaaagaatgtactattagaaaaattaaaaatgaaatgttgagagacttcagcaatgtggttctaatttttttccactgagaaagaagatctttaatttcatattaatggttctgtatattttgggtcatctttttattttttaagaatatcaagtcaattcatttttctttccctatttaaaaaaaaaggtgttttcacagaatgagtgcacttaaaaagtgaagtgaaggaggaggtaacagtagagacgatggcaatatcatcaaggacaaaagtaaaaacgtttagctacctgctgatttttagtgactgttcatatatgttgtatttcaagtatggctggtgaagccagtcagcttttcgggacgttagcaagtggaaactgagtcagtatcatccaaaaccatatctagtcttaacacatggagaatgctggagtgagggttgtgagttcagggtatataatcaagaaaacactcccagcataatgctaggggtcaccagtgtccatcccccagaactgtatggatctaggatatacacagctgcgttgcattaagaaagagatgaaatctctattaaaatacacaagatttttgtatctccttgtgcagaggatatttgccactgcccattgggaagcagacaagttatagggggctgggggccaacactggcaagtaggaaaccacgggtcggacaggtgagcaaaatgtgctggcaggtgggcaccactgggagacccacactgcacacccgggcaccgtatgaacaggaaagaggaaggaagctggacgaagcccctcagggaccctgtgctgaccatgctgggcccaccggcaaaagggagatattcagttccttgtctcatccttaaggtttcttccacaacatctgaatacaagcatgtttaactgggaaaatgtctatgtcatgcgtgaataacaccagcagcaaacactcacacatcacgcagacacggccggcagcatgctgacgcttttaggtatttttcactcatgcaattttcacatattttcactcatttcatttgcacggaaattctatgaggtagatgctgttatcaaatccacattacagatgagggacccagggtccaggaaggtgaactggcagaagtctcccagctggtagaacagggctgcaaggcatcgattcccaggtgtctcacagccctgagaagatggcgttttccctatcagtggctctgaggaagtcaagccttcagtctctacctctcccaccaattcttttggaaacagcaaaccaatgttacacacacttcctaatccagaggaagctagaacacgatttttaaatttatttagtaaaataaaactttttttgcagatgtaacgaa

SEQ ID NO: 823 - DNA, 67504 bp, Homo sapiens
tttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 824 - DNA, 75926 bp, Homo sapiens
taaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg
